US007208280B2

(12) United States Patent
Jakobovits et al.

(10) Patent No.: US 7,208,280 B2
(45) Date of Patent: Apr. 24, 2007

(54) NUCLEIC ACID AND CORRESPONDING PROTEIN ENTITLED 101P3A41 USEFUL IN TREATMENT AND DETECTION OF CANCER

(75) Inventors: Aya Jakobovits, Beverly Hills, CA (US); Arthur B. Raitano, Los Angeles, CA (US); Daniel E. H. Afar, Brisbane, CA (US); Douglas Saffran, Encinitas, CA (US); Rene S. Hubert, Los Angeles, CA (US); Mary Faris, Los Angeles, CA (US); Pia M. Challita-Eid, Encino, CA (US)

(73) Assignee: Agensys, Inc., Santa Monica, CA (US)

( * ) Notice: Subject to any disclaimer, the term of this patent is extended or adjusted under 35 U.S.C. 154(b) by 693 days.

(21) Appl. No.: 10/001,469

(22) Filed: Oct. 31, 2001

(65) Prior Publication Data
US 2003/0091562 A1 May 15, 2003

Related U.S. Application Data

(63) Continuation-in-part of application No. 09/680,728, filed on Oct. 5, 2000, now Pat. No. 6,790,631.

(60) Provisional application No. 60/291,118, filed on May 15, 2001, now abandoned, provisional application No. 60/157,902, filed on Oct. 5, 1999, now abandoned.

(51) Int. Cl.
*G01M 33/53* (2006.01)
(52) U.S. Cl. ............... 435/7.1; 435/7.23; 530/350; 530/387.1
(58) Field of Classification Search ............... 435/7.1, 435/6, 7.23; 530/350, 387.1
See application file for complete search history.

(56) References Cited

U.S. PATENT DOCUMENTS

| 6,800,746 B2 * | 10/2004 | Xu et al. .................... 536/23.1 |
| 2002/0022248 A1 | 2/2002 | Xu et al. |
| 2002/0192763 A1 | 12/2002 | Xu et al. .................... 435/69.7 |
| 2003/0088059 A1 | 5/2003 | Zozulya |
| 2003/0113798 A1 | 6/2003 | Brown et al. |
| 2003/0213004 A1 | 11/2003 | Jakobovits et al. |

FOREIGN PATENT DOCUMENTS

| EP | 1270724 | 1/2003 |
| WO | WO 96/39435 | 12/1996 |
| WO | WO 99/06550 | 2/1999 |
| WO | WO 00/04149 | 1/2000 |
| WO | WO 00/20590 | 4/2000 |
| WO | WO-01/27158 | 4/2001 |
| WO | WO-01/73032 | 10/2001 |
| WO | WO-01/74904 | 10/2001 |
| WO | WO2002016548 | 2/2002 |
| WO | WO200261087 | 8/2002 |
| WO | WO200289747 | 11/2002 |
| WO | WO200292842 | 11/2002 |
| WO | WO2003009814 | 2/2003 |

OTHER PUBLICATIONS

Bowie et al (Science, 1990, 257 : 1306-1310).*
(Chang F et al, 2003, Leukemia, 17: 1263-1293.*
Hummler E et al, 1994, PNAS, USA, 91: 5647-5661.*
Xu Xin et al, 2001, FASEB J, 15(4): A313.*
MPSRCH search report, us-10-001-469a.2866.rag, p. 10.*
Alberts et al., Molecular Biology of the Cell, 3rd Edition (1994) p. 465.
Bepler et al., Genomics (1999) 55(2):164-175.
Burgess et al., Journal of Cell Biology (1990) 11:2129-2138.
EMBL Sequence Accession No. A06681.Gcg_Geneseq_D, Jun. 13, 2000 (first entry).
EMBL Sequence Accession No. AF101565, Jan. 29, 1999, Nov. 8, 2000.
Fu et al., EMBO Journal (1996) 15:4392-4401.
Gillies et al., Human Antibodies and Hybridomas (1990) 1(1):47-54.
Harrison, Immunol Series 49:411-464.
Hubert et al., Proc. Natl. Acad. Sci. USA (1999) 96(25):14523-14528.
Jansen, Pediatric Res. (1995) 37(6):681-686.
Klein et al., Nat. Med. (1997) 3:402.
Lazar et al., Molecular and Cell Biology (1988) 8:1247-1252.
Maniatis et al. (Eds.), Mol. Cloning (1989) Cold Spring Harbor Laboratory, Cold Spring Harbor, p. 17.31.
McLean and Hill, Eur.J. of Cancer (1993) 29A:2243-2248.
Nageneseq, EMBL Sequence Accession No. X40518, Jun. 18, 1999 (first entry).
Pinto et al., Clin. Cancer Res. (1996) 2(9):1445-1451.
Reiter et al., Proc. Natl. Acad. Sci. USA (1998) 95:1735.
Shantz and Pegg, Int. J. of Biochem. and Cell Biol. (1999) 31:107-122.
Sjogren, Immunotechnology (1997) 3(3):161-172.
Su et al., Proc. Natl. Acad. Sci. USA (1996) 93:7252.
Tao et al., The Journal of Immunology (1989) 143(8):2595-2601.
Supplementary Partial European Search Report for EP 02 73 6898, mailed on Oct. 4, 2005, 4 pages.

* cited by examiner

*Primary Examiner*—Jeffrey Siew
*Assistant Examiner*—Minh-Tam Davis
(74) *Attorney, Agent, or Firm*—Morrison & Foerster LLP

(57) ABSTRACT

A novel gene (designated 101P3A11 and also referred to as PHOR-1) and its encoded protein are described. While 101P3A11 exhibits tissue specific expression in normal adult tissue, it is aberrantly expressed in prostate, colon and kidney cancers. Thus, 101P3A11 provides a diagnostic, prognostic, prophylactic and/or therapeutic target for cancer. The 101P3A11 gene or fragment thereof, or its encoded protein or a fragment thereof, can be used to elicit an immune response.

3 Claims, 50 Drawing Sheets

Figure 1

```
GATCAAACTTCTTTTCCATTCAGAGTCCTCTGATTCAGATTTTAATGTTAACATTTTGGAAGACAGTATTCAGAAAAAAAATTTCCTTA
ATAAAAATACAACTCAGATCCTTCAAATATGAAACTGGTTGGGGAATCTCCATTTTTTCAATATTATTTTCTTCTTTGTTTTCTTGCTA
CGTATAATTATTAATATCCTGACTAGGTTGTGGTTGGAGGGTTATTACTTTTCATTTTACCATGCAGTCCAAATCTAAACTGCTTCTAC
TGATGGTTTACAGCATTCTGAGATAAGAATGGTACATCTAGAGAACATTTGCCAAAGGCCTAAGCACAGCAAAGGAAAATAAACACAGA
ATATAATAAAATGAGATAATCTAGCTTAAAACTATAACTTCCTCTTTAGAACTCCCAACCACATTTGGATC
```

FIG. 2A

```
              9              18             27             36             45             54
5' CAG AGA GGC TGT ATT TCA GTG CAG CCT GCC AGA CCT CTT CTG GAG GAA GAC TGG
   --- --- --- --- --- --- --- --- --- --- --- --- --- --- --- --- --- ---
             63              72             81             90             99            108
   ACA AAG GGG GTC ACA CAT TCC TTC CAT ACG GTT GAG CCT CTA CCT GCC TGG TGC
   --- --- --- --- --- --- --- --- --- --- --- --- --- --- --- --- --- ---
            117             126            135            144            153            162
   TGG TCA CAG TTC AGC TTC TTC ATG ATG GTG GAT CCC AAT GGC AAT GAA TCC AGT
   --- --- --- --- --- --- --- --- --- --- --- --- --- --- --- --- --- ---
                                         M   M   V   D   P   N   G   N   E   S   S
            171             180            189            198            207            216
   GCT ACA TAC TTC ATC CTA ATA GGC CTC CCT GGT TTA GAA GAG GCT CAG TTC TGG
   --- --- --- --- --- --- --- --- --- --- --- --- --- --- --- --- --- ---
    A   T   Y   F   I   L   I   G   L   P   G   L   E   E   A   Q   F   W
            225             234            243            252            261            270
   TTG GCC TTC CCA TTG TGC TCC CTC TAC CTT ATT GCT GTG CTA GGT AAC TTG ACA
   --- --- --- --- --- --- --- --- --- --- --- --- --- --- --- --- --- ---
    L   A   F   P   L   C   S   L   Y   L   I   A   V   L   G   N   L   T
            279             288            297            306            315            324
   ATC ATC TAC ATT GTG CGG ACT GAG CAC AGC CTG CAT GAG CCC ATG TAT ATA TTT
   --- --- --- --- --- --- --- --- --- --- --- --- --- --- --- --- --- ---
    I   I   Y   I   V   R   T   E   H   S   L   H   E   P   M   Y   I   F
            333             342            351            360            369            378
   CTT TGC ATG CTT TCA GGC ATT GAC ATC CTC ATC TCC ACC TCA TCC ATG CCC AAA
   --- --- --- --- --- --- --- --- --- --- --- --- --- --- --- --- --- ---
    L   C   M   L   S   G   I   D   I   L   I   S   T   S   S   M   P   K
            387             396            405            414            423            432
   ATG CTG GCC ATC TTC TGG TTC AAT TCC ACT ACC ATC CAG TTT GAT GCT TGT CTG
   --- --- --- --- --- --- --- --- --- --- --- --- --- --- --- --- --- ---
    M   L   A   I   F   W   F   N   S   T   T   I   Q   F   D   A   C   L
            441             450            459            468            477            486
   CTA CAG ATT TTT GCC ATC CAC TCC TTA TCT GGC ATG GAA TCC ACA GTG CTG CTG
   --- --- --- --- --- --- --- --- --- --- --- --- --- --- --- --- --- ---
    L   Q   I   F   A   I   H   S   L   S   G   M   E   S   T   V   L   L
            495             504            513            522            531            540
   GCC ATG GCT TTT GAC CGC TAT GTG GCC ATC TGT CAC CCA CTG CGC CAT GCC ACA
   --- --- --- --- --- --- --- --- --- --- --- --- --- --- --- --- --- ---
    A   M   A   F   D   R   Y   V   A   I   C   H   P   L   R   H   A   T
            549             558            567            576            585            594
   GTA CTT ACG TTG CCT CGT GTC ACC AAA ATT GGT GTG GCT GCT GTG GTG CGG GGG
   --- --- --- --- --- --- --- --- --- --- --- --- --- --- --- --- --- ---
    V   L   T   L   P   R   V   T   K   I   G   V   A   A   V   V   R   G
            603             612            621            630            639            648
   GCT GCA CTG ATG GCA CCC CTT CCT GTC TTC ATC AAG CAG CTG CCC TTC TGC CGC
   --- --- --- --- --- --- --- --- --- --- --- --- --- --- --- --- --- ---
    A   A   L   M   A   P   L   P   V   F   I   K   Q   L   P   F   C   R
```

FIG. 2B

```
             657           666           675           684           693           702
TCC AAT ATC CTT TCC CAT TCC TAC TGC CTA CAC CAA GAT GTC ATG AAG CTG GCC
--- --- --- --- --- --- --- --- --- --- --- --- --- --- --- --- --- ---
 S   N   I   L   S   H   S   Y   C   L   H   Q   D   V   M   K   L   A 711           720           729           738           747           756
TGT GAT GAT ATC CGG GTC AAT GTC GTC TAT GGC CTT ATC GTC ATC ATC TCC GCC
--- --- --- --- --- --- --- --- --- --- --- --- --- --- --- --- --- ---
 C   D   D   I   R   V   N   V   V   Y   G   L   I   V   I   I   S   A 765           774           783           792           801           810
ATT GGC CTG GAC TCA CTT CTC ATC TCC TTC TCA TAT CTG CTT ATT CTT AAG ACT
--- --- --- --- --- --- --- --- --- --- --- --- --- --- --- --- --- ---
 I   G   L   D   S   L   L   I   S   F   S   Y   L   L   I   L   K   T 819           828           837           846           855           864
GTG TTG GGC TTG ACA CGT GAA GCC CAG GCC AAG GCA TTT GGC ACT TGC GTC TCT
--- --- --- --- --- --- --- --- --- --- --- --- --- --- --- --- --- ---
 V   L   G   L   T   R   E   A   Q   A   K   A   F   G   T   C   V   S 873           882           891           900           909           918
CAT GTG TGT GCT GTG TTC ATA TTC TAT GTA CCT TTC ATT GGA TTG TCC ATG GTG
--- --- --- --- --- --- --- --- --- --- --- --- --- --- --- --- --- ---
 H   V   C   A   V   F   I   F   Y   V   P   F   I   G   L   S   M   V 927           936           945           954           963           972
CAT CGC TTT AGC AAG CGG CGT GAC TCT CCG CTG CCC GTC ATC TTG GCC AAT ATC
--- --- --- --- --- --- --- --- --- --- --- --- --- --- --- --- --- ---
 H   R   F   S   K   R   R   D   S   P   L   P   V   I   L   A   N   I 981           990           999          1008          1017          1026
TAT CTG CTG GTT CCT CCT GTG CTC AAC CCA ATT GTC TAT GGA GTG AAG ACA AAG
--- --- --- --- --- --- --- --- --- --- --- --- --- --- --- --- --- ---
 Y   L   L   V   P   P   V   L   N   P   I   V   Y   G   V   K   T   K 1035          1044          1053          1062          1071          1080
GAG ATT CGA CAG CGC ATC CTT CGA CTT TTC CAT GTG GCC ACA CAC GCT TCA GAG
--- --- --- --- --- --- --- --- --- --- --- --- --- --- --- --- --- ---
 E   I   R   Q   R   I   L   R   L   F   H   V   A   T   H   A   S   E 1089          1098          1107          1116          1125          1134
CCC TAG GTG TCA GTG ATC AAA CTT CTT TTC CAT TCA GAG TCC TCT GAT TCA GAT
--- --- --- --- --- --- --- --- --- --- --- --- --- --- --- --- --- ---
 P   *

1143          1152          1161          1170          1179          1188
TTT AAT GTT AAC ATT TTG GAA GAC AGT ATT CAG AAA AAA AAT TTC CTT AAT AAA
--- --- --- --- --- --- --- --- --- --- --- --- --- --- --- --- --- ---
            1197          1206          1215          1224          1233          1242
AAA TAC AAC TCA GAT CCT TCA AAT ATG AAA CTG GTT GGG GAA TCT CCA TTT TTT
--- --- --- --- --- --- --- --- --- --- --- --- --- --- --- --- --- ---
            1251          1260          1269          1278          1287          1296
CAA TAT TAT TTT CTT CTT TGT TTT CTT GCT ACA TAT AAT TAT TAA TAC CCT GAC
--- --- --- --- --- --- --- --- --- --- --- --- --- --- --- --- --- ---
            1305          1314          1323          1332          1341          1350
TAG GTT GTG GTT GGA GGG TTA TTA CTT TTC ATT TTA CCA TGC AGT CCA AAT CTA
--- --- --- --- --- --- --- --- --- --- --- --- --- --- --- --- --- ---
```

FIG. 2C

```
        1359        1368        1377        1386        1395        1404
AAC TGC TTC TAC TGA TGG TTT ACA GCA TTC TGA GAT AAG AAT GGT ACA TCT AGA
--- --- --- --- --- --- --- --- --- --- --- --- --- --- --- --- --- ---
            1413        1422        1431        1440        1449        1458
GAA CAT TTG CCA AAG GCC TAA GCA CGG CAA AGG AAA ATA AAC ACA GAA TAT AAT
--- --- --- --- --- --- --- --- --- --- --- --- --- --- --- --- --- ---
            1467        1476        1485        1494        1503        1512
AAA ATG AGA TAA TCT AGC TTA AAA CTA TAA CTT CCT CTT CAG AAC TCC CAA CCA
--- --- --- --- --- --- --- --- --- --- --- --- --- --- --- --- --- ---
            1521        1530        1539        1548        1557        1566
CAT TGG ATC TCA GAA AAA TGC TGT CTT CAA AAT GAC TTC TAC AGA GAA GAA ATA
--- --- --- --- --- --- --- --- --- --- --- --- --- --- --- --- --- ---
            1575        1584        1593        1602        1611        1620
ATT TTT CCT CTG GAC ACT AGC ACT TAA GGG GAA GAT TGG AAG TAA AGC CTT GAA
--- --- --- --- --- --- --- --- --- --- --- --- --- --- --- --- --- ---
            1629        1638        1647        1656        1665        1674
AAG AGT ACA TTT ACC TAC GTT AAT GAA AGT TGA CAC ACT GTT CTG AGA GTT TTC
--- --- --- --- --- --- --- --- --- --- --- --- --- --- --- --- --- ---
            1683        1692        1701        1710        1719        1728
ACA GCA TAT GGA CCC TGT TTT TCC TAT TTA ATT TTC TTA TCA ACC CTT TAA TTA
--- --- --- --- --- --- --- --- --- --- --- --- --- --- --- --- --- ---
            1737        1746        1755        1764        1773        1782
GGC AAA GAT ATT ATT AGT ACC CTC ATT GTA GCC ATG GGA AAA TTG ATG TTC AGT
--- --- --- --- --- --- --- --- --- --- --- --- --- --- --- --- --- ---
            1791        1800        1809        1818        1827        1836
GGG GAT CAG TGA ATT AAA TGG GGT CAT ACA AGT ATA AAA ATT AAA AAA AAA AAA
--- --- --- --- --- --- --- --- --- --- --- --- --- --- --- --- --- ---
            1845        1854        1863        1872        1881        1890
GAC TTC ATG CCC AAT CTC ATA TGA TGT GGA AGA ACT GTT AGA GAG ACC AAC AGG
--- --- --- --- --- --- --- --- --- --- --- --- --- --- --- --- --- ---
            1899        1908        1917        1926        1935        1944
GTA GTG GGT TAG AGA TTT CCA GAG TCT TAC ATT TTC TAG AGG AGG TAT TTA ATT
--- --- --- --- --- --- --- --- --- --- --- --- --- --- --- --- --- ---
            1953        1962        1971        1980        1989        1998
TCT TCT CAC TCA TCC AGT GTT GTA TTT AGG AAT TTC CTG GCA ACA GAA CTC ATG
--- --- --- --- --- --- --- --- --- --- --- --- --- --- --- --- --- ---
            2007        2016        2025        2034        2043        2052
GCT TTA ATC CCA CTA GCT ATT GCT TAT TGT CCT GGT CCA ATT GCC AAT TAC CTG
--- --- --- --- --- --- --- --- --- --- --- --- --- --- --- --- --- ---
            2061        2070        2079        2088        2097        2106
TGT CTT GGA AGA AGT GAT TTC TAG GTT CAC CAT TAT GGA AGA TTC TTA TTC AGA
--- --- --- --- --- --- --- --- --- --- --- --- --- --- --- --- --- ---
            2115        2124        2133        2142        2151        2160
AAG TCT GCA TAG GGC TTA TAG CAA GTT ATT TAT TTT TAA AAG TTC CAT AGG TGA
--- --- --- --- --- --- --- --- --- --- --- --- --- --- --- --- --- ---
            2169        2178        2187        2196        2205        2214
TTC TGA TAG GCA GTG AGG TTA GGG AGC CAC CAG TTA TGA TGG GAA GTA TGG AAT
--- --- --- --- --- --- --- --- --- --- --- --- --- --- --- --- --- ---
            2223        2232        2241        2250        2259        2268
GGC AGG TCT TGA AGA TAA CAT TGG CCT TTT GAG TGT GAC TCG TAG CTG GAA AGT
--- --- --- --- --- --- --- --- --- --- --- --- --- --- --- --- --- ---
            2277        2286        2295        2304        2313        2322
GAG GGA ATC TTC AGG ACC ATG CTT TAT TTG GGG CTT TGT GCA GTA TGG AAC AGG
--- --- --- --- --- --- --- --- --- --- --- --- --- --- --- --- --- ---
            2331        2340        2349        2358        2367        2376
GAC TTT GAG ACC AGG AAA GCA ATC TGA CTT AGG CAT GGG AAT CAG GCA TTT TTG
--- --- --- --- --- --- --- --- --- --- --- --- --- --- --- --- --- ---
```

FIG. 2D

```
           2385          2394          2403          2412          2421          2430
     CTT CTG AGG GGC TAT TAC CAA GGG TTA ATA GGT TTC ATC TTC AAC AGG ATA TGA
     --- --- --- --- --- --- --- --- --- --- --- --- --- --- --- --- --- ---
               2439          2448          2457          2466          2475          2484
     CAA CAG TGT TAA CCA AGA AAC TCA AAT TAC AAA TAC TAA AAC ATG TGA TCA TAT
     --- --- --- --- --- --- --- --- --- --- --- --- --- --- --- --- --- ---
               2493          2502          2511          2520          2529          2538
     ATG TGG TAA GTT TCA TTT TCT TTT TCA ATC CTC AGG TTC CCT GAT ATG GAT TCC
     --- --- --- --- --- --- --- --- --- --- --- --- --- --- --- --- --- ---
               2547          2556          2565          2574          2583          2592
     TAT AAC ATG CTT TCA TCC CCT TTT GTA ATG GAT ATC ATA TTT GGA AAT GCC TAT
     --- --- --- --- --- --- --- --- --- --- --- --- --- --- --- --- --- ---
               2601          2610          2619          2628          2637          2646
     TTA ATA CTT GTA TTT GCT GCT GGA CTG TAA GCC CAT GAG GGC ACT GTT TAT TAT
     --- --- --- --- --- --- --- --- --- --- --- --- --- --- --- --- --- ---
               2655          2664          2673          2682          2691          2700
     TGA ATG TCA TCT CTG TTC ATC ATT GAC TGC TCT TTG CTC ATC ATT GAA TCC CCC
     --- --- --- --- --- --- --- --- --- --- --- --- --- --- --- --- --- ---
               2709          2718          2727          2736          2745          2754
     AGC AAA GTG CCT AGA ACA TAA TAG TGC TTA TGC TTG ACA CCG GTT ATT TTT CAT
     --- --- --- --- --- --- --- --- --- --- --- --- --- --- --- --- --- ---
               2763          2772          2781          2790          2799          2808
     CAA ACC TGA TTC CTT CTG TCC TGA ACA CAT AGC CAG GCA ATT TTC CAG CCT TCT
     --- --- --- --- --- --- --- --- --- --- --- --- --- --- --- --- --- ---
               2817          2826          2835          2844          2853          2862
     TTG AGT TGG GTA TTA TTA AAT TCT GGC CAT TAC TTC CAA TGT GAG TGG AAG TGA
     --- --- --- --- --- --- --- --- --- --- --- --- --- --- --- --- --- ---
               2871          2880          2889          2898          2907          2916
     CAT GTG CAA TTT CTA TAC CTG GCT CAT AAA ACC CTC CCA TGT GCA GCC TTT CAT
     --- --- --- --- --- --- --- --- --- --- --- --- --- --- --- --- --- ---
               2925          2934          2943          2952          2961          2970
     GTT GAC ATT AAA TGT GAC TTG GGA AGC TAT GTG TTA CAC AGA GTA AAT CAC CAG
     --- --- --- --- --- --- --- --- --- --- --- --- --- --- --- --- --- ---
               2979          2988          2997          3006          3015          3024
     AAG CCT GGA TTT CTG AAA AAA CTG TGC AGA GCC AAA CCT CTG TCA TTT GCA ACT
     --- --- --- --- --- --- --- --- --- --- --- --- --- --- --- --- --- ---
               3033          3042          3051          3060          3069          3078
     CCC ACT TGT ATT TGT ACG AGG CAG TTG GAT AAG TGA AAA ATA AAG TAC TAT TGT
     --- --- --- --- --- --- --- --- --- --- --- --- --- --- --- --- --- ---
               3087          3096          3105          3114          3123          3132
     GTC AAG AAA AAA AAA AAA AAA AAA AAA AAA AAA AAA AAA AAA AAA AAA AAA AAA
     --- --- --- --- --- --- --- --- --- --- --- --- --- --- --- --- --- ---

AAA A 3'
     --- -
```

Figure 3: Protein Sequence for 101P3A11.

MVDPNGNESSATYFILIGLPGLEEAQFWLAFPLCSLYLIAVLGNLTIIYIVRTEHSLHEPMYIFLCMLSGIDILISTS
SMPKMLAIFWFNSTTIQFDACLLQIFAIHSLSGMESTVLLAMAFDRYVAICHPLRHATVLTLPRVTKIGVAAVV
RGAALMAPLPVFIKQLPFCRSNILSHSYCLHQDVMKLACDDIRVNVVYGLIVIISAIGLDSLLISFSYLLILKTVL
GLTREAQAKAFGTCVSHVCAVFIFYVPFIGLSMVHRFSKRRDSPLPVILANIYLLVPPVLNPIVYGVKTKEIRQRI
LRLFHVATHASEP

Figure 4

Alignment of 101P3A11 (Sbjct) with mouse olfactory receptor S25 (Query)

```
Query:  34  GNYTVVTEFILLGLTDDITVSVILFVMFLIVYSVTLMGNLNIIVLIRTSPQLHTPMYLFL  93
            GN +  T FIL+GL         L      +Y + ++GNL II ++RT   LH PMY+FL
Sbjct:   6  GNESSATYFILIGLPGLEEAQFWLAFPLCSLYLIAVLGNLTIIYIVRTEHSLHEPMYIFL  65

Query:  94  SHLAFLDIGYSSSVTPIMLRGFLRKGTFIPVAGCVAQLCIVVAFGTSESFLLASMAYDRY  153
            L+ +DI S+S P ML F    T I   C+ Q+ + +    ES +L +MA+DRY
Sbjct:  66  CMLSGIDILISTSSMPKMLAIFWFNSTTIQFDACLLQIFAIHSLSGMESTVLLAMAFDRY  125

Query: 154  VAICSPLLYSTQMSSTVCILLVGTSYLGGWVNAWIFTGCSLNLSFCGPNKINHFFCDYSP  213
            VAIC PL ++T ++      + +  + G        L  FC  N ++H +C +
Sbjct: 126  VAICHPLRHATVLTLPRVTKIGVAAVVRGAALMAPLPVFIKQLPFCRSNILSHSYCLHQD  185

Query: 214  LLKLSCSHDFSFEVIPAISSGSIIVVTVFIIALSYVYILVSILKMRSTEGRQKAFSTCTS  273
            ++KL+C      V    I   S I +   +I+ SY+ IL ++L + + E + KAF TC S
Sbjct: 186  VMKLACDDIRVNVVYGLIVIISAIGLDSLLISFSYLLILKTVLGL-TREAQAKAFGTCVS  244

Query: 274  HLTAVTLFFGTITFIYVMPQSSYSTDQNK----VVSVFYTVVIPMLNPLIYSFRNKEVKE  329
            H+ AV +F+ + FI +     +S ++        +++  Y' +V P+LNP++Y + KE+++
Sbjct: 245  HVCAVFIFY--VPFIGLSMVHRFSKRRDSPLPVILANIYLLVPPVLNPIVYGVKTKEIRQ  302

Query: 330  AMKKL  334
            +  +L
Sbjct: 303  RILRL  307
```

101P3A11 Hydrophilicity profile
(Hopp T.P., Woods K.R., 1981. Proc. Natl. Acad. Sci. U.S.A. 78:3824-3828)

101P3A11 Hydropathicity Profile
(Kyte J., Doolittle R.F., 1982. J. Mol. Biol. 157:105-132)

101P3A11 % Accessible Residues Profile
(Janin J., 1979. Nature 277:491-492)

101P3A11 Average Flexibility Profile
(Bhaskaran R., Ponnuswamy P.K., 1988.
Int. J. Pept. Protein Res. 32:242-255)

101P3A11 Beta-turn Profile
(Deleage, G., Roux B. 1987. Protein Engineering 1:289-294)

Figure 10A. Expression of 101P3A11 by RT-PCR
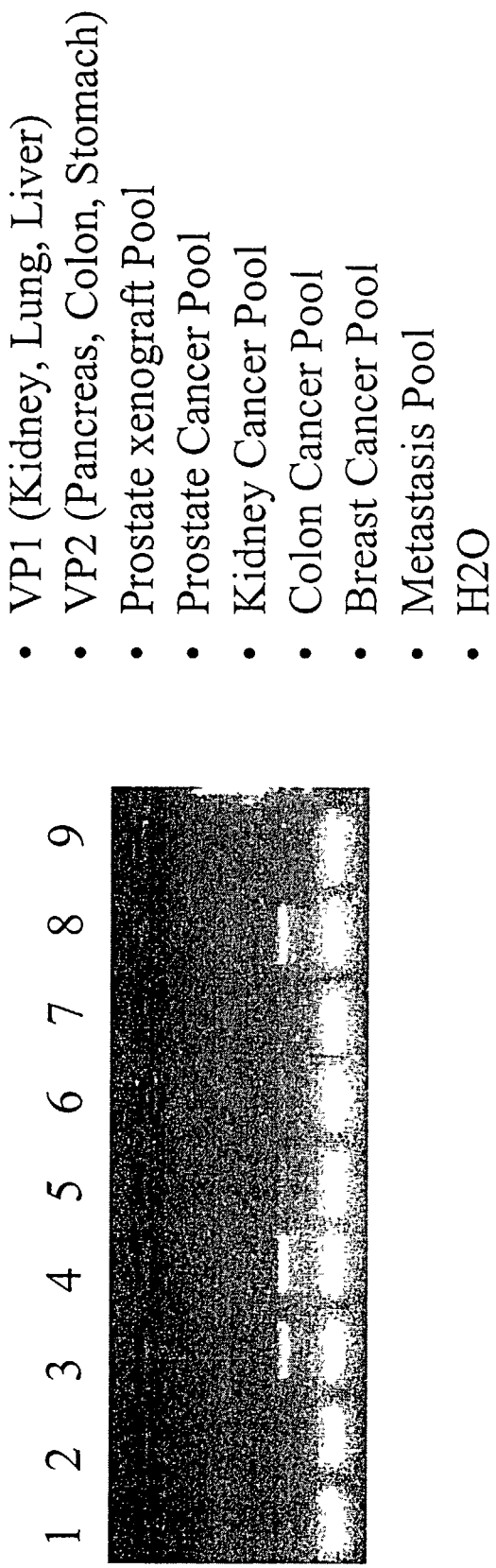
- VP1 (Kidney, Lung, Liver)
- VP2 (Pancreas, Colon, Stomach)
- Prostate xenograft Pool
- Prostate Cancer Pool
- Kidney Cancer Pool
- Colon Cancer Pool
- Breast Cancer Pool
- Metastasis Pool
- H2O

Figure 11. Expression of 101P3A11 in Human Patient Cancer Specimens
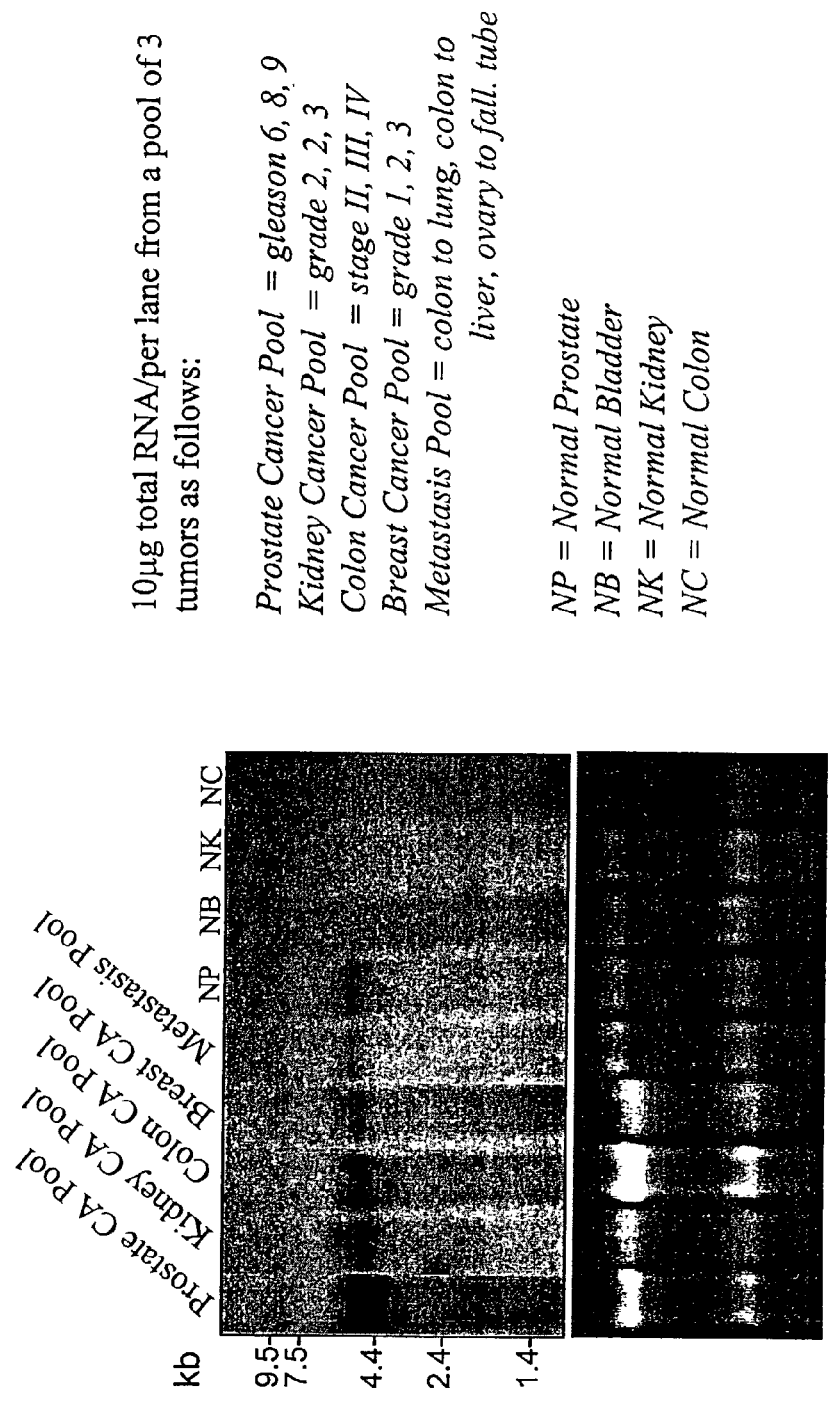

Figure 13. Expression of 101P3A11 in Colon Cancer Patient Specimens
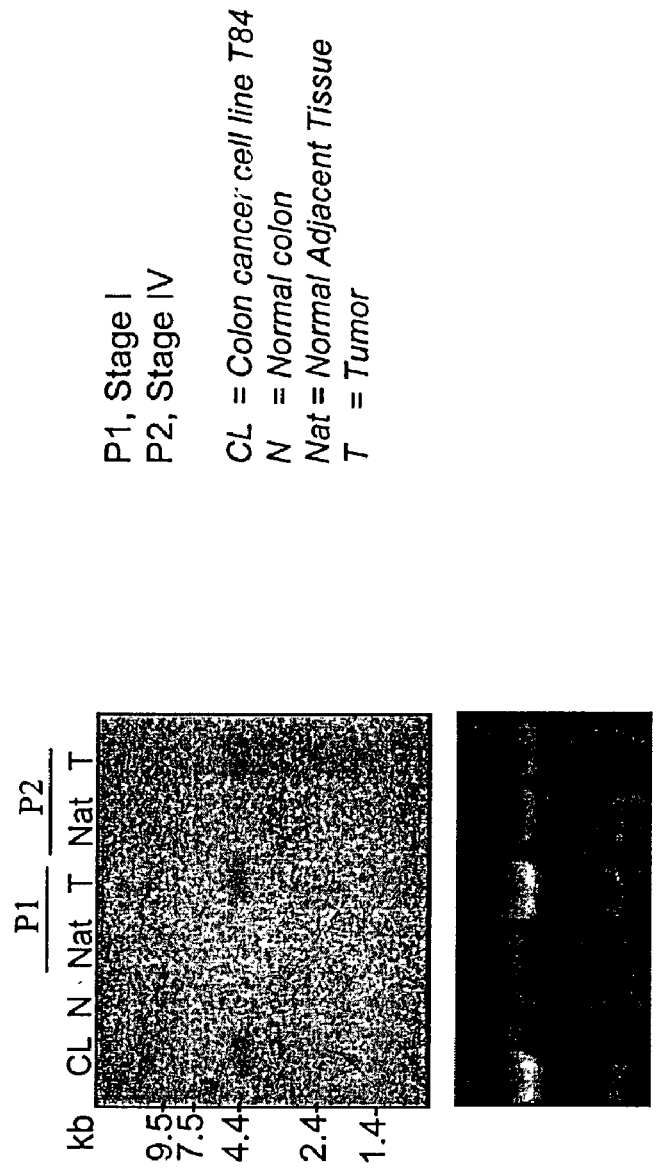

Figure 14. Expression of 101P3A11 in Kidney Cancer Patient Specimens
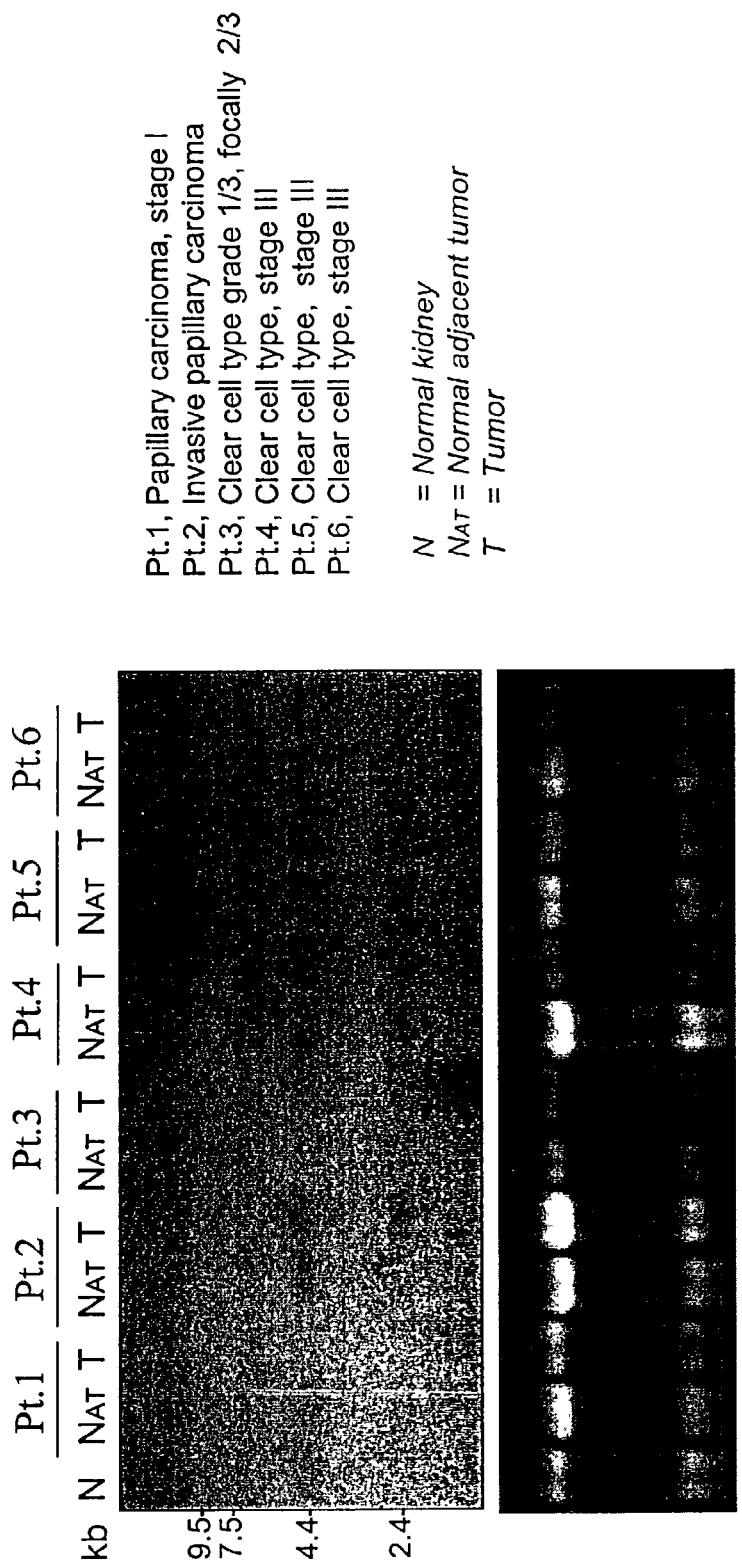
Pt.1, Papillary carcinoma, stage I
Pt.2, Invasive papillary carcinoma
Pt.3, Clear cell type grade 1/3, focally 2/3
Pt.4, Clear cell type, stage III
Pt.5, Clear cell type, stage III
Pt.6, Clear cell type, stage III
N = Normal kidney
N$_{AT}$ = Normal adjacent tumor
T = Tumor

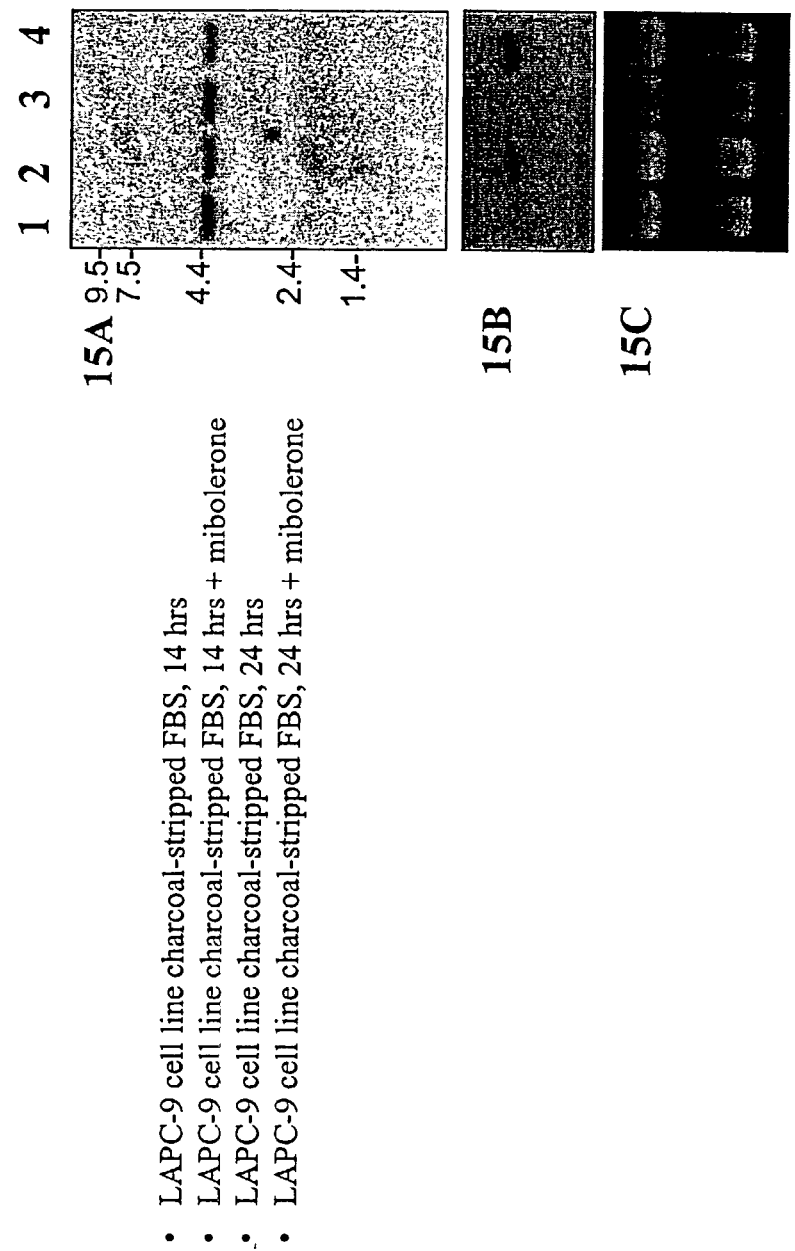
Figure 15A-15C. Androgen Regulation of 101P3A11 in Tissue Culture Cells
- LAPC-9 cell line charcoal-stripped FBS, 14 hrs
- LAPC-9 cell line charcoal-stripped FBS, 14 hrs + mibolerone
- LAPC-9 cell line charcoal-stripped FBS, 24 hrs
- LAPC-9 cell line charcoal-stripped FBS, 24 hrs + mibolerone Figure 16. Androgen Regulation of 101P3A11 *In Vivo*
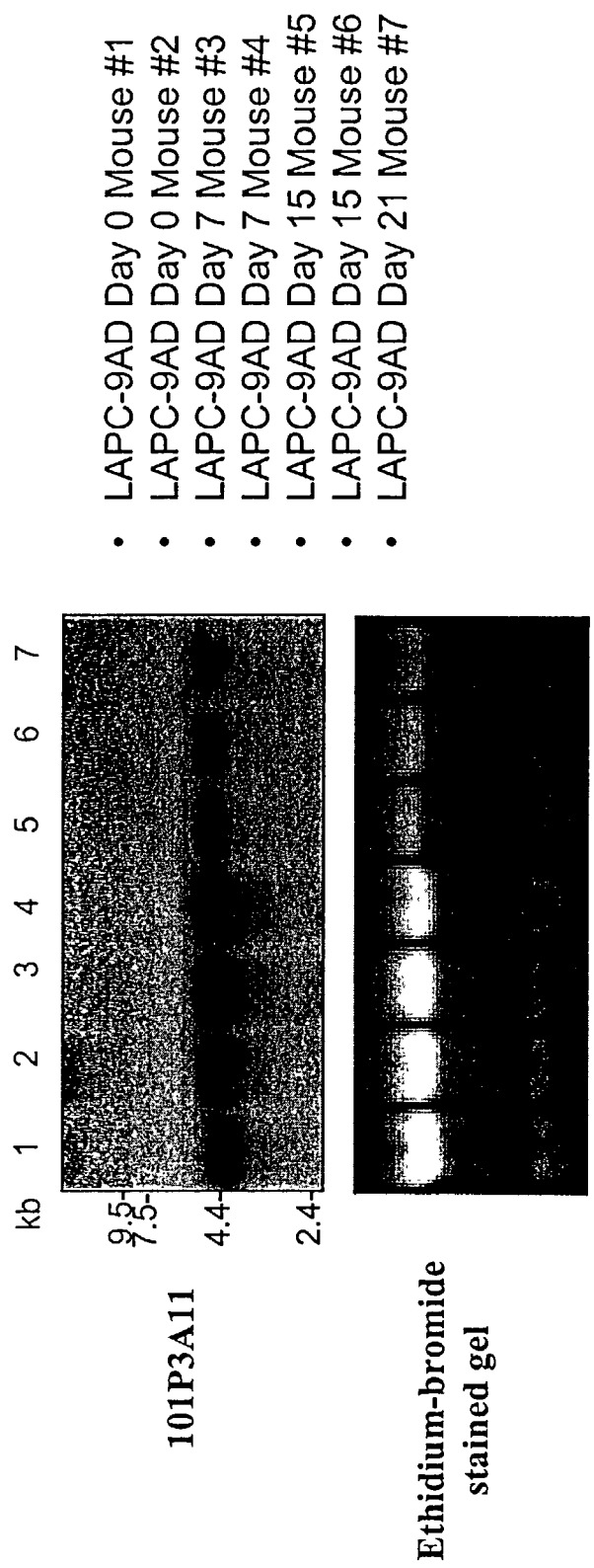

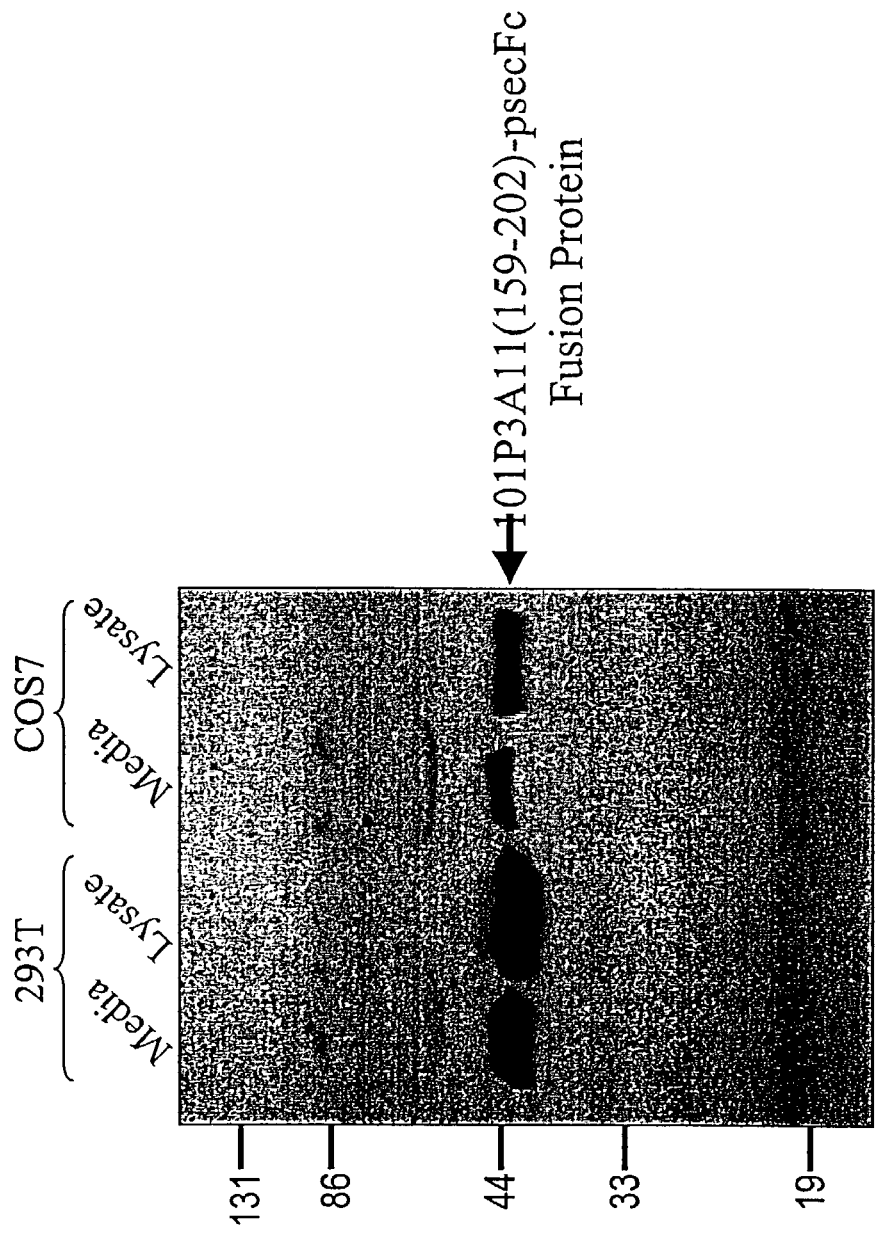
Figure 17. Expression and Detection of 101P3A11(159-202)-psecFc Fusion Protein

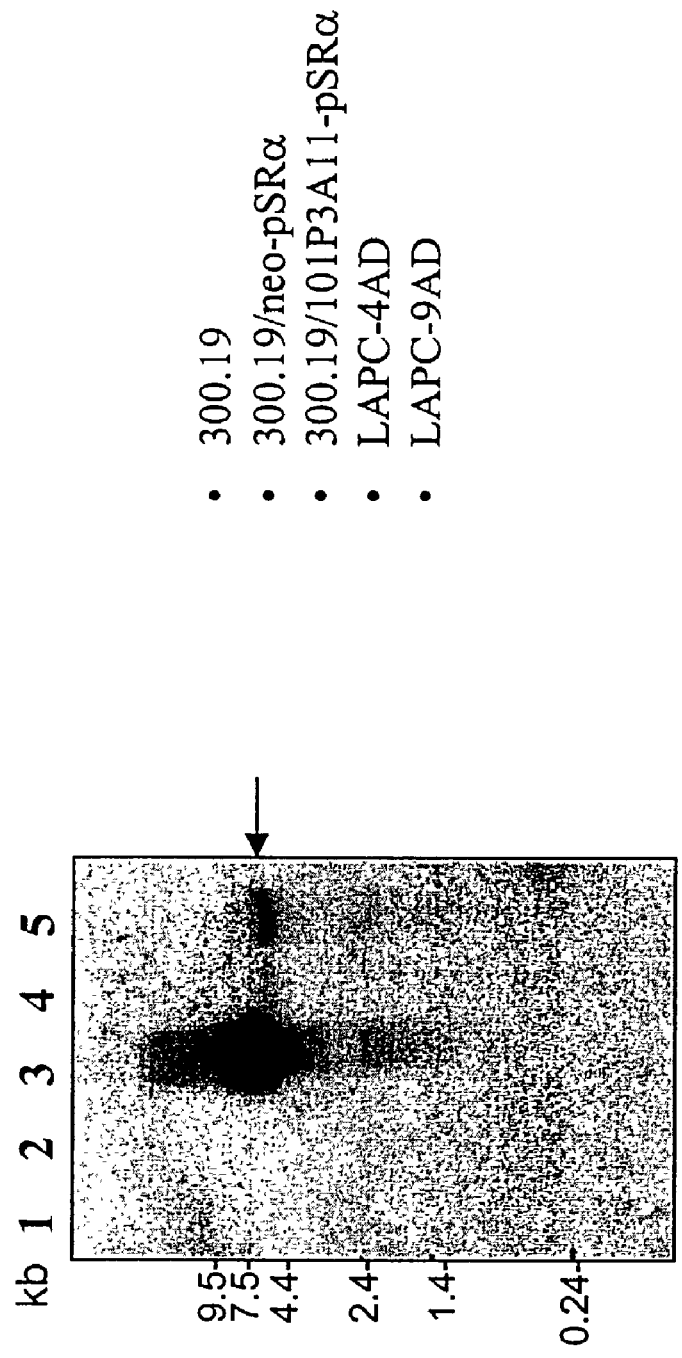
Figure 18. Expression of 101P3A11 in 300.19 Cells

Figure 19A. Secondary structure prediction of 101P3A11

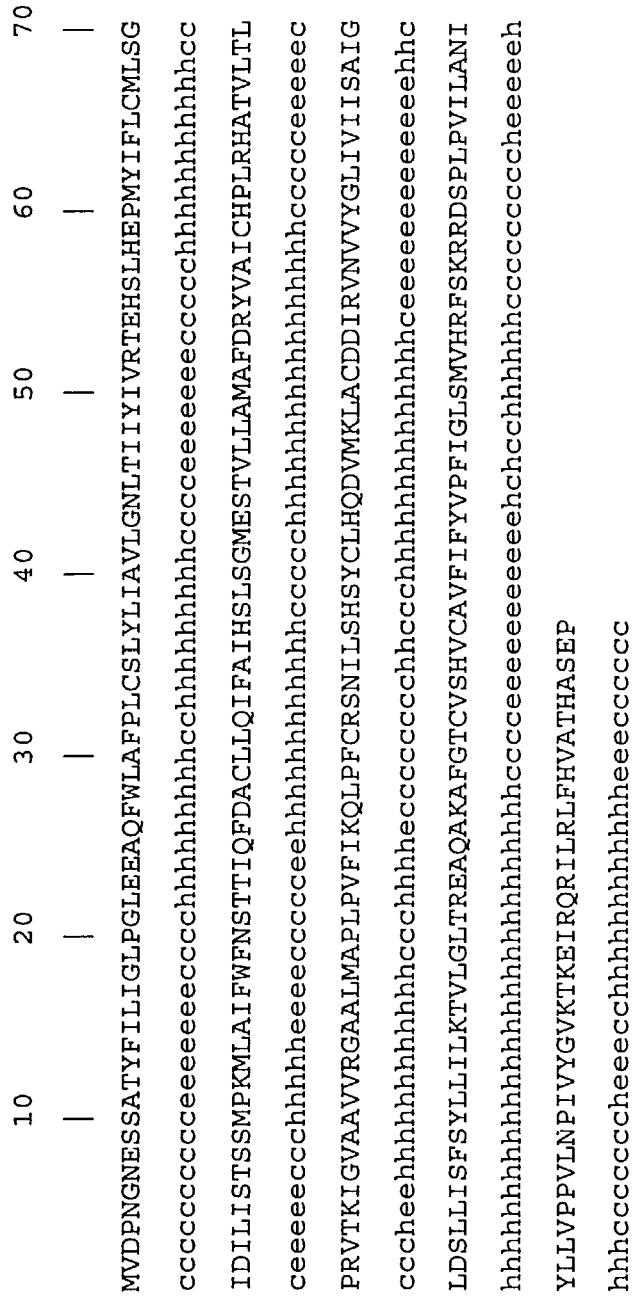

```
         10        20        30        40        50        60        70
         |         |         |         |         |         |         |
MVDPNGNESSATYFILIGLPGLEEAQFWLAFPLCSLYLIAVLGNLTIIYIVRTEHSLHEPMYIFLCMLSG
cccccccceeeeecccchhhhhhhcchhhhhhcccceeeeccccchhhhhhhhhhcc
IDILISTSSMPKMLAIFWFNSTTIQFDACLLQIFAIHSLSGMESTVLLAMAFDRYVAICHPLRHATVLTL
ceeeeecchhhhheeeeccccceehhhhhhhhhccccchhhhhhhhhhhccccceeeeec
PRVTKIGVAAVVRGAALMAPLPVFIKQLPFFCRSNILSHSYCLHQDVMKLACDDIRVNVVYGLIVIISAIG
cccheehhhhhhhhhhcchhheeccccccchhccchhhhhhhhhceeeeeeeeeehhc
LDSLLISFSYLLILKTVLGLTREAQAKAFGTCVSHVCAVFIFYVPFIGLSMVHRFSKRRDSPLPVILANI
hhhhhhhhhhhhhhhhhhhhhhhhhhccceeeeeehchcchhhhhhhcccccccccheeeeeh
YLLVPPVLNPIVYGVKTKEIRQRILRLFHVATHASEP
hhhcccccccheeecchhhhhhhhhheeeccccccc c: random coil    (30.60%)
e: extended strand (21.45%)
h: alpha helix    (47.95%)
```

Figure 19B-19C. Transmembrane prediction of 101P3A11
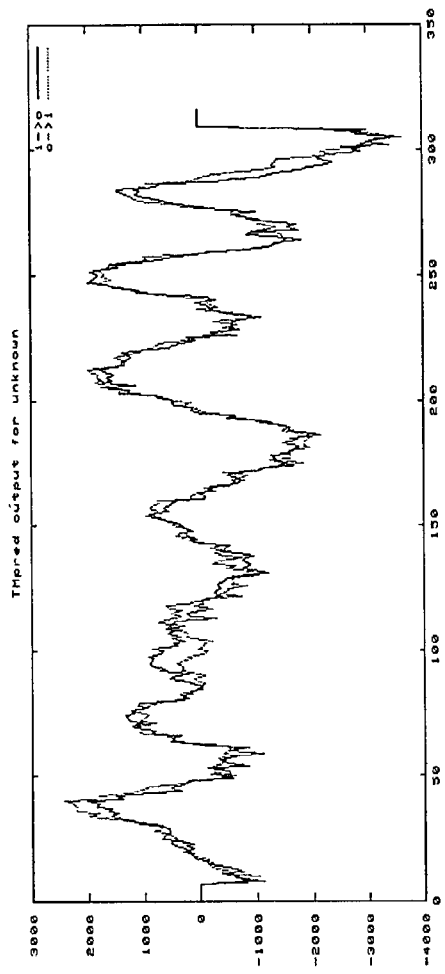
19B
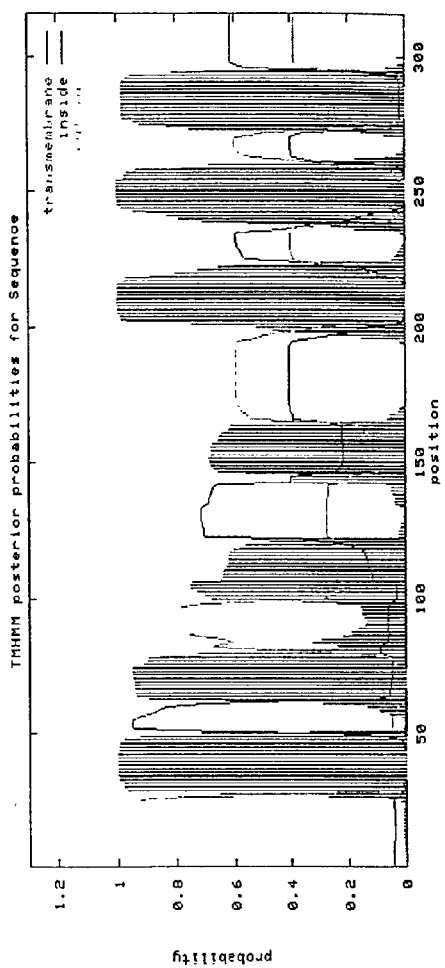
19C

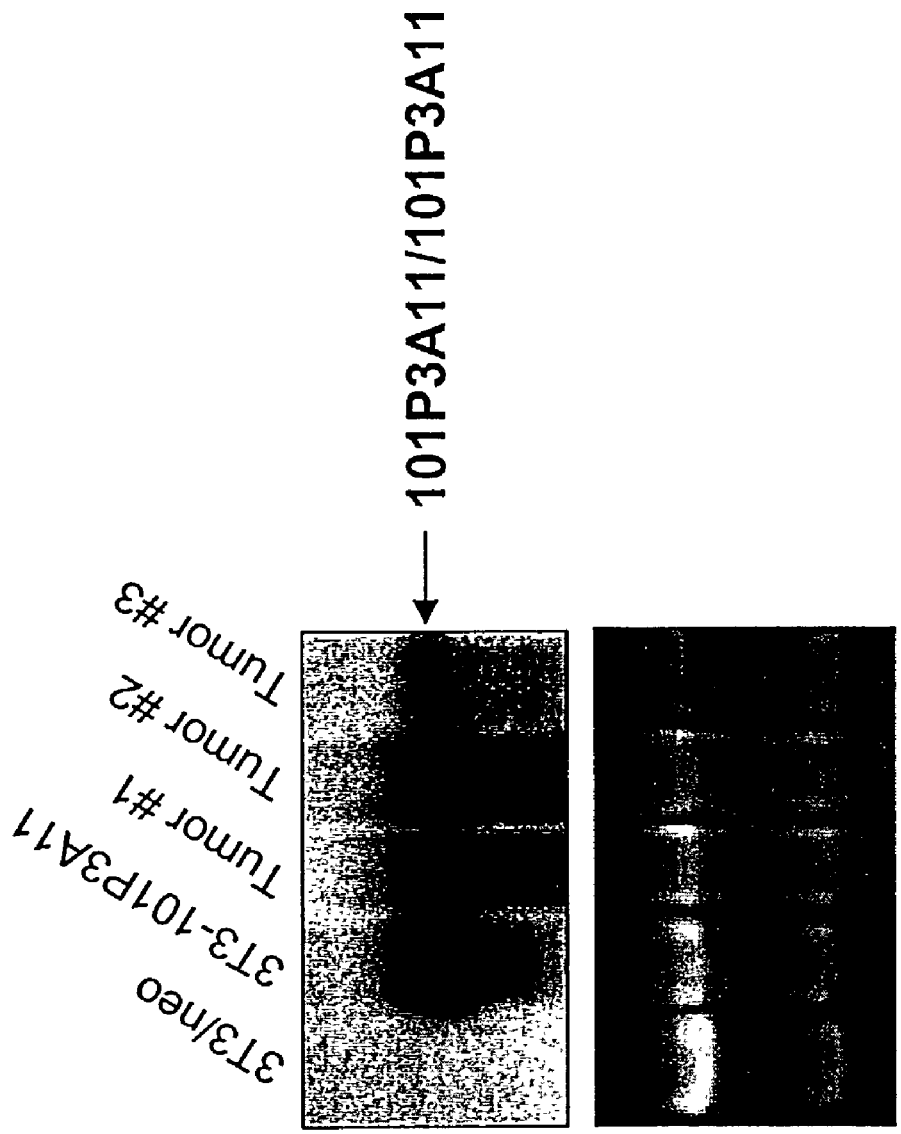
Figure 20. Expression of 101P3A11 in NIH-3T3 Tumors

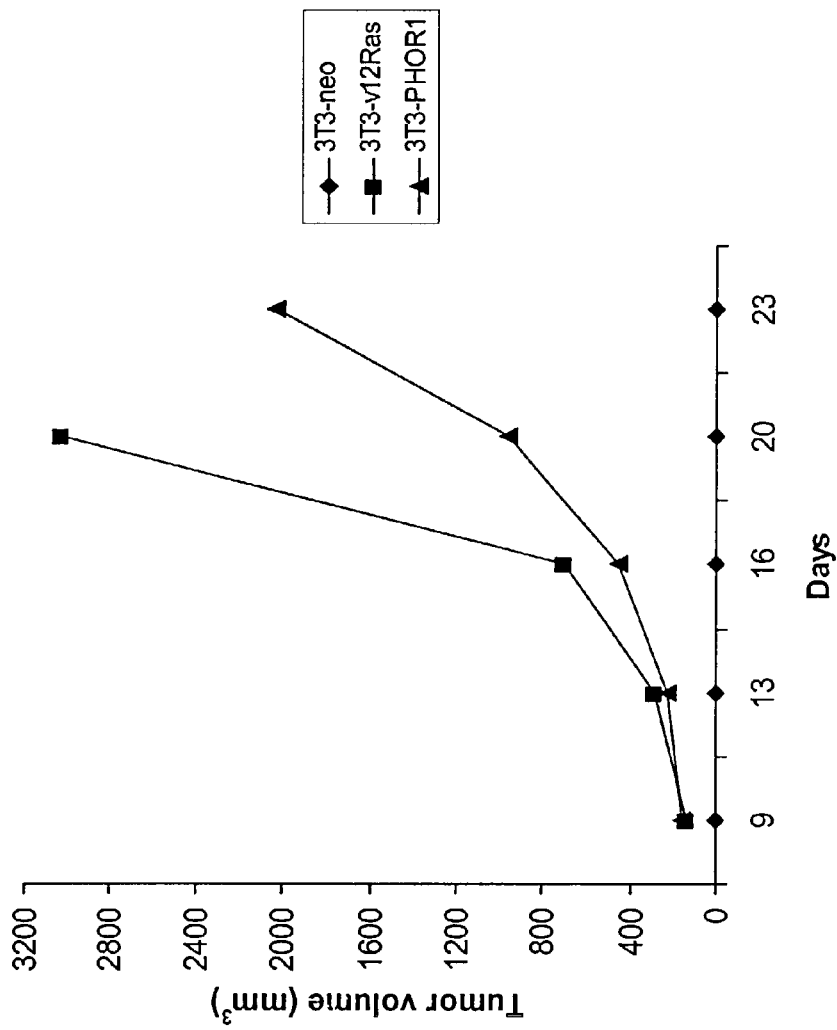
Figure 21: 101P3A11 Induces Tumor Formation of 3T3 Cells
• Injection of 10⁶ 3T3-neo, 3T3-Ras or 3T3-101P3A11 cells subcutaneously into SCID mice revealed that 6/6 3T3-Ras-injected mice formed tumors, 6/6 3T3-101P3A11- injected mice formed tumors, and 0/6 3T3-neo-injected mice formed tumors.

Figure 22: PTX Reduces the *in vivo* Growth of 3T3-101P3A11 Tumors
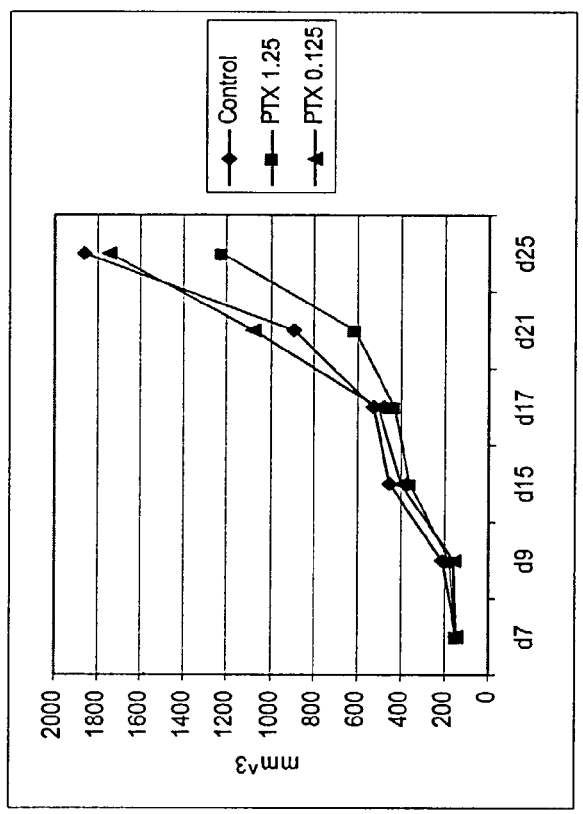
- Pertussis toxin inhibits the sub-cutaneous growth of 3T3-101P3A11 tumors in SCID mice.
- The inhibitory activity of pertussis toxin occurs in a dose dependent manner.

Figure 23: Alignment of 101P3A11-PHOR-1 with the rat GPCR RA1C (gi|3420759).

Identities = 179/299 (59%), Positives = 231/299 (76%), Gaps = 1/299 (0%)

```
PHOR:  14  FILIGLPGLEEAQFWLAFPLCSLYLIAVLGNLTIIYIVRTEHSLHEPMYIFLCMLSGIDI   73
           F+LIG+PGLEEA FW   FPL S+Y +A+ GN   +++IVRTE SLH PMY+FLCML+ ID+
RA1C:  11  FMLIGIPGLEEAHFWFGFPLLSMYAVALFGNCIVVFIVRTERSLHAPMYLFLCMLAAIDL   70

PHOR:  74  LISTSSMPKMLAIFWFNSTTIQFDACLLQIFAIHSLSGMESTVLLAMAFDRYVAICHPLR  133
             +STS+MPK+LA+FWF+S  I FDACL Q+F IH+LS +EST+LLAMAFDRYVAICHPLR
RA1C:  71  ALSTSTMPKILALFWFDSREITFDACLAQMFFIHALSAIESTILLAMAFDRYVAICHPLR  130

PHOR: 134  HATVLTLPRVTKIGVAAVVRGAALMAPLPVFIKQLPFCRSNILSHSYCLHQDVMKLACDD  193
           HA VL        +IG+ A+VRG+     PLP+ IK+L FC SN+LSHSYC+HQDVMKLA  D
RA1C: 131  HAAVLNNTVTVQIGMVALVRGSLFFFPLPLLIKRLAFCHSNVLSHSYCVHQDVMKLAYTD  190

PHOR: 194  IRVNVVYGLIVIISAIGLDSLLISFSYLLILKTVLGL-TREAQAKAFGTCVSHVCAVFIF  252
              NVVYGL I+  +G+D + IS SY LI++ VL L ++  +AKAFGTCVSH+   V F
RA1C: 191  TLPNVVYGLTAILLVMGVDVMFISLSYFLIIRAVLQLPSKSERAKAFGTCVSHIGVVLAF  250

PHOR: 253  YVPFIGLSMVHRFSKRRDSPLPVILANIYLLVPPVLNPIVYGVKTKEIRQRILRLFHVA   311
           YVP IGLS+VHRF    D  + V++  ++YLL+PPV+NPI+YG KTK+IR R+L +F ++
RA1C: 251  YVPLIGLSVVHRFGNSLDPIVHVLMGDVYLLLPPVINPIIYGAKTKQIRTRVLAMFKIS   309
```

Figure 24: Alignment of 101P3A11-PHOR-1 with the human prostate specific GPCR.(gi|13540539)

Identities = 179/299 (59%), Positives = 233/299 (77%), Gaps = 1/299 (0%)

```
PHOR:  14  FILIGLPGLEEAQFWLAFPLCSLYLIAVLGNLTIIYIVRTEHSLHEPMYIFLCMLSGIDI  73
           F+LIG+PGLE+A FW+ FPL S+Y++A+ GN   +++IVRTE SLH PMY+FLCML+ ID+
GPCR:  11  FVLIGIPGLEKAHFWVGFPLLSMYVVAMFGNCIVVFIVRTERSLHAPMYLFLCMLAAIDL  70

PHOR:  74  LISTSSMPKMLAIFWFNSTTIQFDACLLQIFAIHSLSGMESTVLLAMAFDRYVAICHPLR  133
           +STS+MPK+LA+FWF+S   I F+ACL Q+F IH+LS +EST+LLAMAFDRYVAICHPLR
GPCR:  71  ALSTSTMPKILALFWFDSREISFEACLTQMFFIHALSAIESTILLAMAFDRYVAICHPLR  130

PHOR: 134  HATVLTLPRVTKIGVAAVVRGAALMAPLPVFIKQLPFCRSNILSHSYCLHQDVMKLACDD  193
           HA VL      +IG+ AVVRG+    PLP+ IK+L FC SN+LSHSYC+HQDVMKLA  D
GPCR: 131  HAAVLNNTVTAQIGIVAVVRGSLFFFPLPLLIKRLAFCHSNVLSHSYCVHQDVMKLAYAD  190

PHOR: 194  IRVNVVYGLIVIISAIGLDSLLISFSYLLILKTVLGL-TREAQAKAFGTCVSHVCAVFIF  252
               NVVYGL I+  +G+D + IS SY LI++TVL L ++   +AKAFGTCVSH+ V  F
GPCR: 191  TLPNVVYGLTAILLVMGVDVMFISLSYFLIIRTVLQLPSKSERAKAFGTCVSHIGVVLAF  250

PHOR: 253  YVPFIGLSMVHRFSKRRDSPLPVILANIYLLVPPVLNPIVYGVKTKEIRQRILRLFHVA  311
           YVP IGLS+VHRF         + V++ +IYLL+PPV+NPI+YG KTK+IR R+L +F ++
GPCR: 251  YVPLIGLSVVHRFGNSLHPIVRVVMGDIYLLLPPVINPIIYGAKTKQIRTRVLAMFKIS  309
```

Figure 25: Alignment with human olfactory receptor 5I112 (gi|14423836)

```
Identities = 163/304 (53%), Positives = 214/304 (69%), Gaps = 1/304 (0%)

PHOR:   7   NESSATYFILIGLPGLEEAQFWLAFPLCSLYLIAVLGNLTIIYIVRTEHSLHEPMYIFLC  66
            N +   +F+L G+PGLE +  WL+ PLC +Y +A+ GN  I+  VR E SLHEPMY FL
HOR5:   5   NVTHPAFFLLTGIPGLESSHSWLSGPLCVMYAVALGGNTVILQAVRVEPSLHEPMYYFLS  64

PHOR:  67   MLSGIDILISTSSMPKMLAIFWFNSTTIQFDACLLQIFAIHSLSGMESTVLLAMAFDRYV  126
            MLS  D+ IS +++P +L  F  N+   I FDACL+Q+F IH  S MES +LLAM+FDRYV
HOR5:  65   MLSFSDVAISMATLPTVLRTFCLNARNITFDACLIQMFLIHFFSMMESGILLAMSFDRYV  124

PHOR: 127   AICHPLRHATVLTLPRVTKIGVAAVVRGAALMAPLPVFIKQLPFCRSNILSHSYCLHQDV  186
            AIC PLR+ATVLT   +  +G+ A  R    + PLP  IK+LP CRSN+LSHSYCLH D+
HOR5: 125   AICDPLRYATVLTTEVIAAMGLGAAARSFITLFPLPFLIKRLPICRSNVLSHSYCLHPDM  184

PHOR: 187   MKLACDDIRVNVVYGLIVIISAIGLDSLLISFSYLLILKTVLGL-TREAQAKAFGTCVSH  245
            M+LAC DI +N +YGL V++S  G+D   I  SY+LIL++V+    +RE + KA  TCVSH
HOR5: 185   MRLACADISINSIYGLFVLVSTFGMDLFFIFLSYVLILRSVMATASREERLKALNTCVSH  244

PHOR: 246   VCAVFIFYVPFIGLSMVHRFSKRRDSPLPVILANIYLLVPPVLNPIVYGVKTKEIRQRIL  305
            + AV   FYVP IG+S VHRF K     + V+++N+YL VPPVLNP++Y  KTKEIR+ I
HOR5: 245   ILAVLAFYVPMIGVSTVHRFGKHVPCYIHVLMSNVYLFVPPVLNPLIYSAKTKEIRRAIF  304

PHOR: 306   RLFH  309
            R+FH
HOR5: 305   RMFH  308
```

Figure 26: 101P3A11 Modulated Tyrosine Phosphorylation in NIH-3T3 Cells
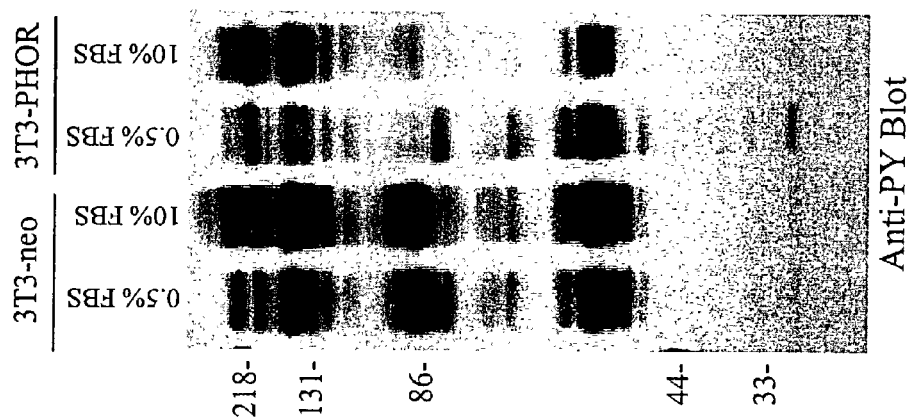
- 101P3A11 mediated the de-phosphorylation of proteins at 200, 120-140, 85-90 and 55 kDa
- 101P3A11 induced the phsophorylation of proteins at 80 and 29 kDa in NIH-3T3 cells.

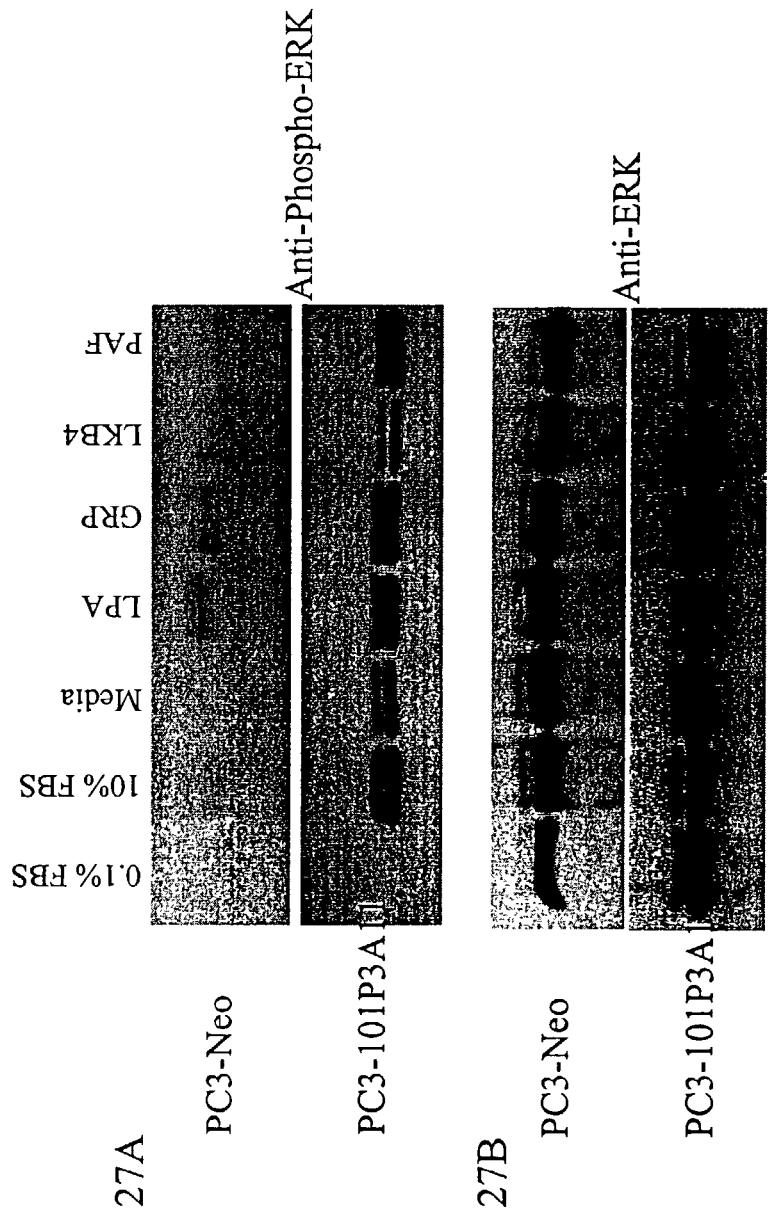
Figures 27A-27B: ERK Phosphorylation by PCR Ligands in 101P3A11 Expressing Cells
• FBS, lipophosphatidic acid, gastrin releasing peptide, leukotriene and platelet activating factor induced the phosphorylation of ERK in 101P3A11 expressing cells.

Figure 28: Inhibition of 101P3A11-Mediated ERK Activation by PD98059
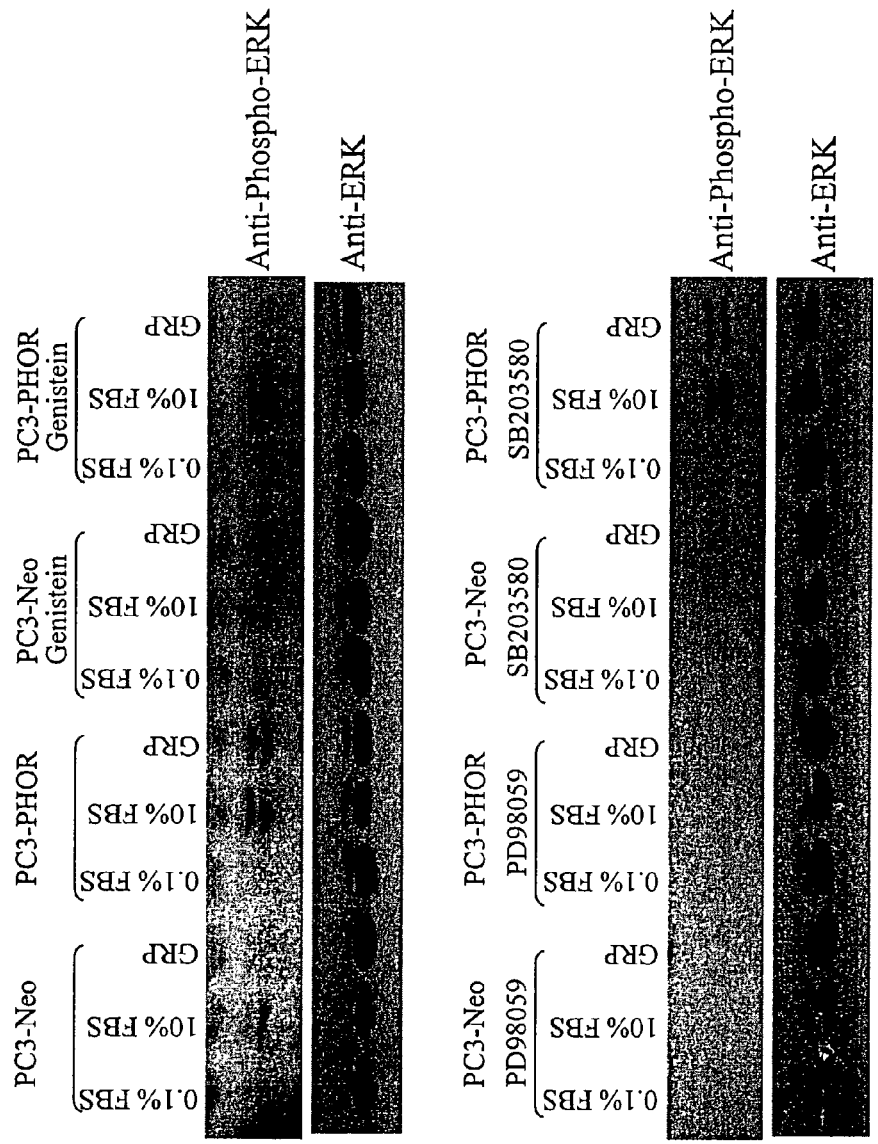
• ERK phosphorylation was inhibited by a MEK specific(PD98059) but not a p38 specific (SB203580) inhibitor in PC3-101P3A11 cells.

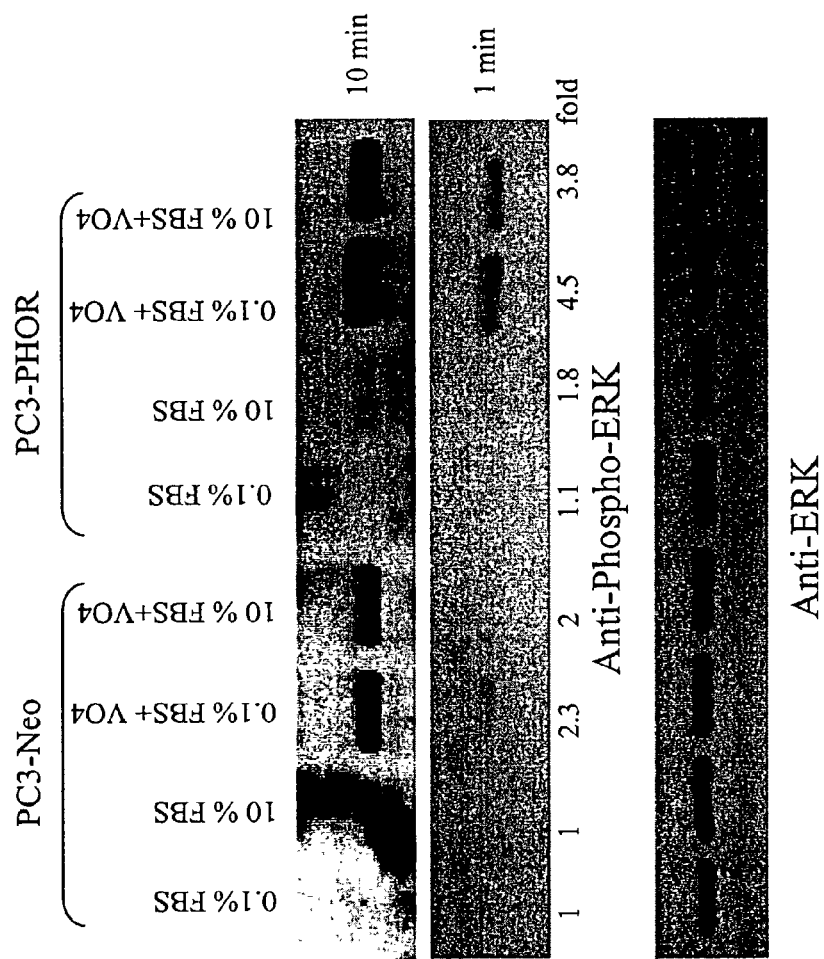
Figure 29: Enhanced ERK Phosphorylation in Sodium Orthovanadate Treated PC3-101P3A11 Cells
• Sodium orthovanadate induced increased ERK phosphorylation in PC3-101P3A11 cells relative to PC3-neo cells.

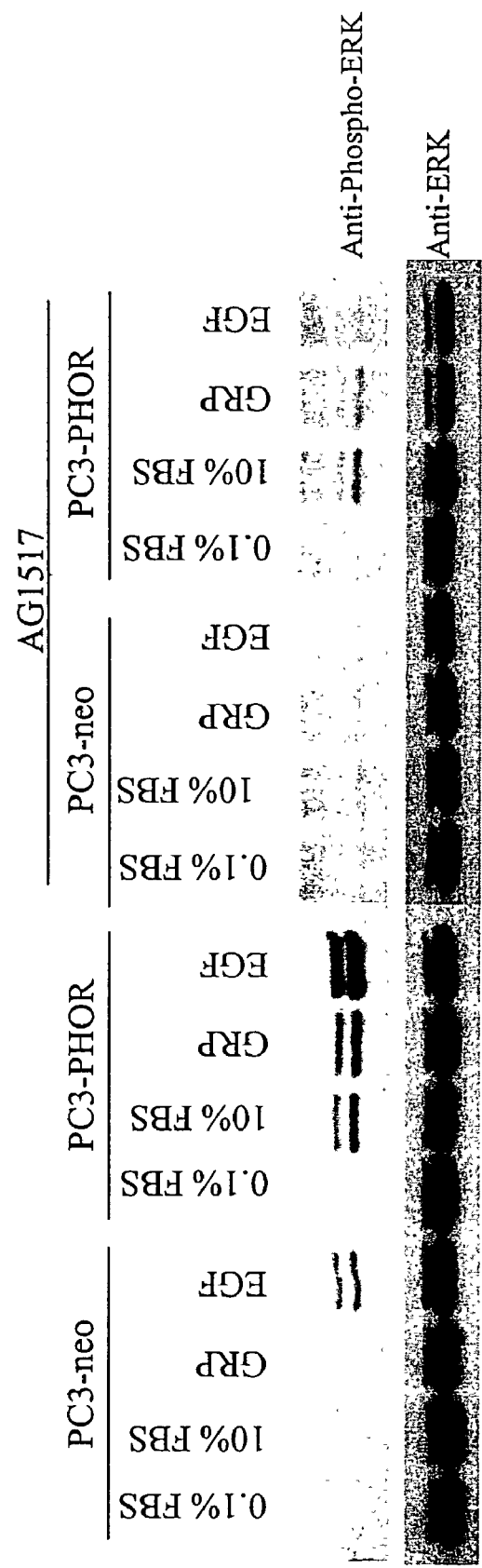
Figure 30: Inhibition of 101P3A11-Mediated ERK Phosphorylation by AG1517
- The EGFR inhibitor, AG1517, inhibits EGF-mediated ERK phosphorylation in control and 101P3A11 expressing PC3 cells.
- AG1517 partially inhibits 101P3A11 mediated ERK phosphorylation in PC3 cells.

Figure 31A-31B: Activation of p38 in PC3-101P3A11 Cells
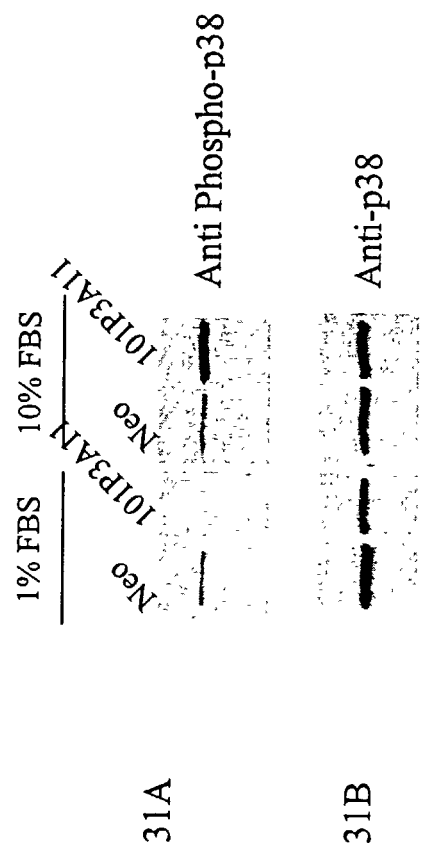
31A
31B
• Expression of 101P3A11 mediates p38 phosphorylation in cells treated with 10% FBS.

Figure 32: 101P3A11 Induced Accumulation of cAMP in PC3 Cells

| | | Fold change in [cAMP] | |
|---|---|---|---|
| | | PC3-Neo | PC3-PHOR |
| 0.1%FBS | -PTX | 1 | 4.302 |
| | +PTX | 1.403 | 2.577 |
| 10%FBS | -PTX | 2.738 | 6.978 |
| | +PTX | 2.163 | 2.752 |

Fold Change in cAMP accumulation was calculated relative to PC3-neo cells grown in 0.1%FBS

- Expression of 101P3A11 increased the accumulation of cAMP in cells treated with 0.1% and 10% FBS.
- FBS-induced cAMP accumulation in 101P3A11 cells was inhibited by pertussis toxin.

Figure 33: Pertussis Toxin Inhibits 101P3A11 Mediated ERK Phosphorylation
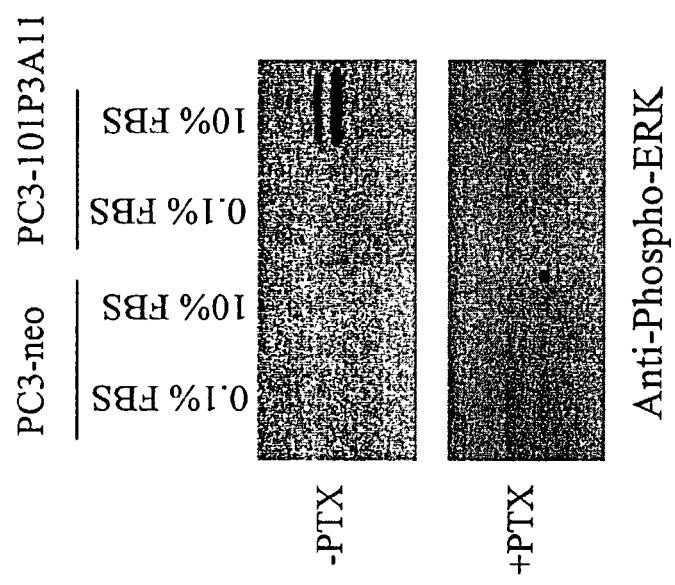
•Pertussis toxin inhibited FBS- mediated ERK phosphorylation in 101P3A11 expressing cells.

Figure 34: Pertussis Toxin Inhibited ERK Phosphorylation in PC3-101P3A11 Cells
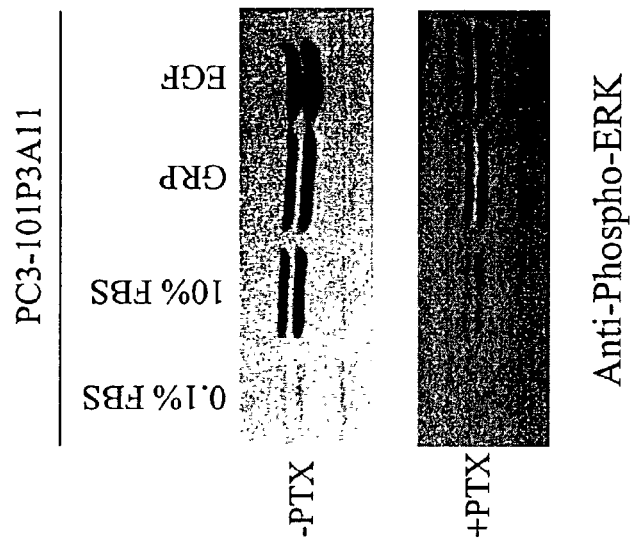
Anti-Phospho-ERK
- Pertussis toxin inhibited FBS- mediated ERK phosphorylation in 101P3A11 expressing cells.
- The inhibitory activity of pertussis toxin on ERK phosphorylation was more dramatic in FBS-treated than EGF or GRP-treated PC3-101P3A11 cells.

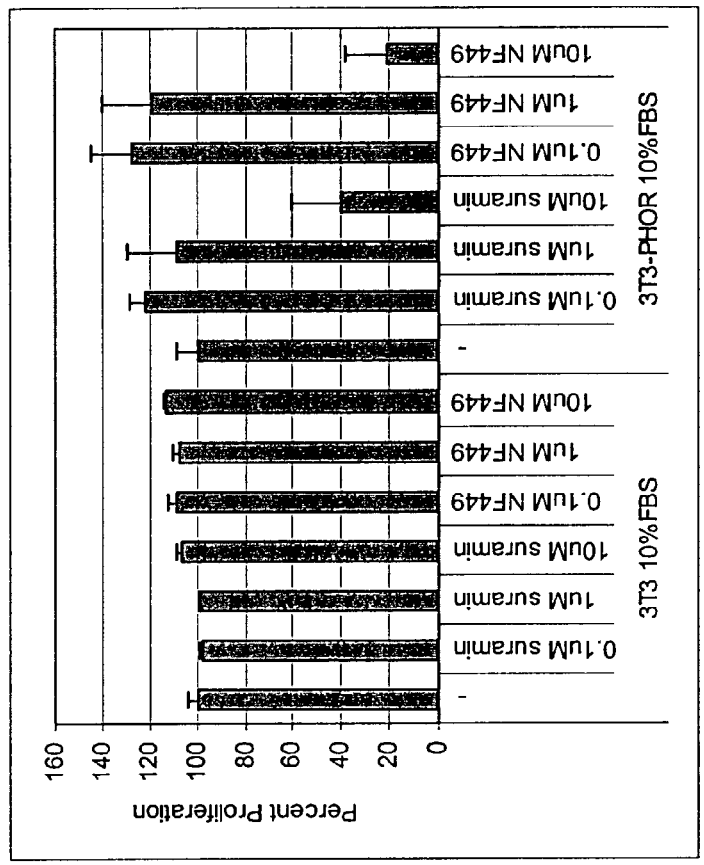
Figure 35: Inhibition of 101P3A11 Mediated Signaling by Suranim
- Control NIH 3T3 and 3T3-101P3A11 cells were grown in the presence of absence of G protein inhibitors suranim and NF449. Proliferation was analyzed by Alamar blue after 72 hours.
- Suranim and NF449 inhibited the proliferation of 101P3A11 expressing but not control cells.

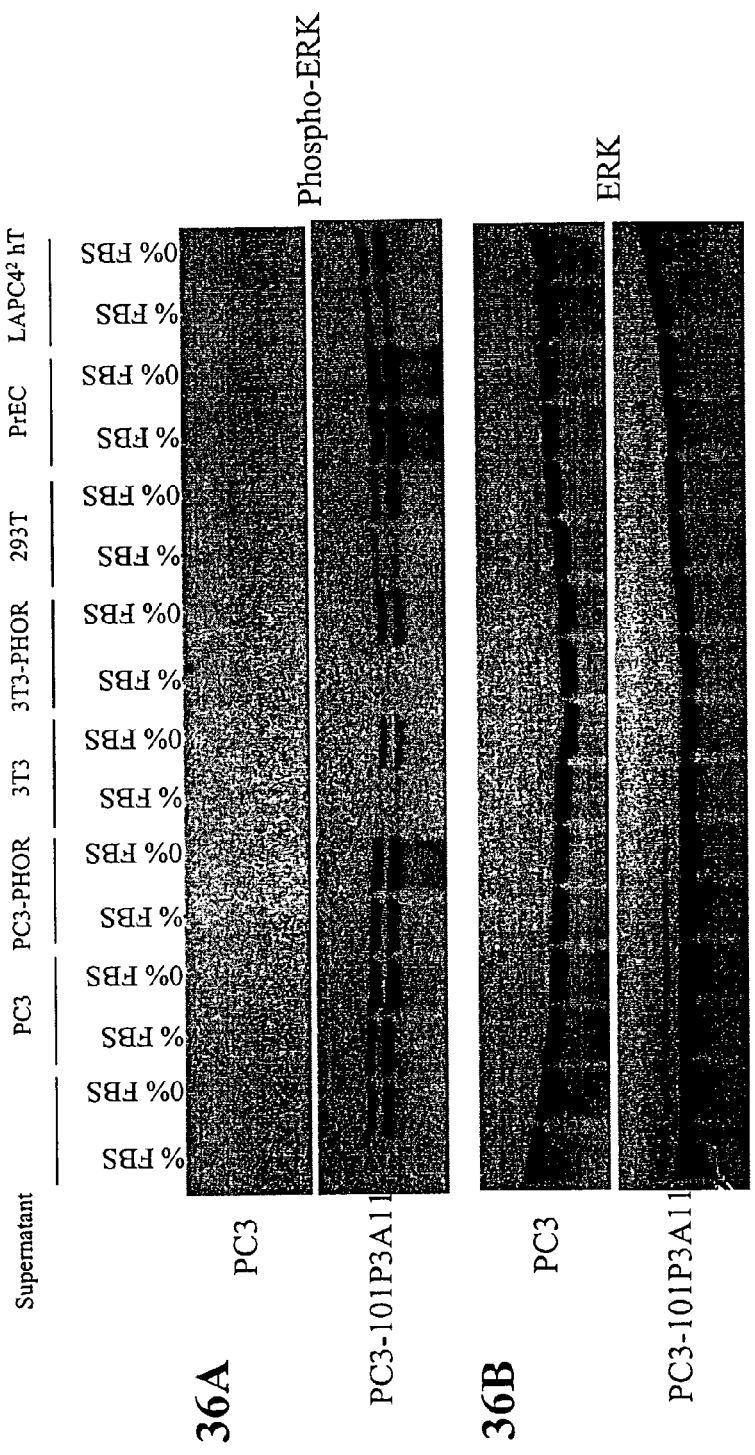
Figures 36A-36B: 101P3A11 Mediated ERK Phosphorylation By Conditioned Media
- Supernatants from PC3, PC3-101P3A11, PrEC and LAPC4² cells induce ERK phosphorylation in PC3 101P3A11 but not PC3 cells.
- Supernatants from 3T3 and 293T cells had little specific effect on ERK phosphorylation.

Figure 37: 101P3A11 Enhances The Proliferation of 3T3 Cells
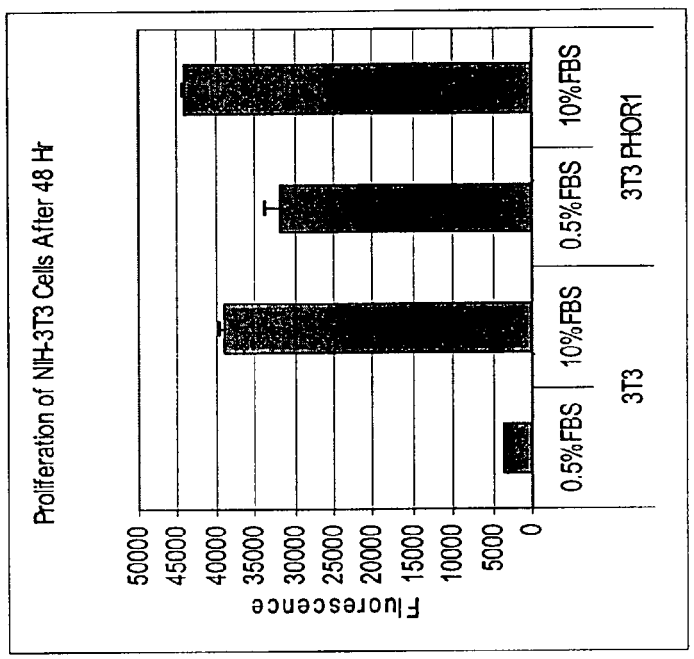
- Control NIH 3T3 and 3T3-101P3A11 cells were grown in the presence of absence 0.5 or 10% FBS. Proliferation was analyzed by Alamar blue after 48 hours.
- Expression of 101P3A11 induced a 6 fold increase in the proliferation of 3T3 cells grown in 0.5% FBS.

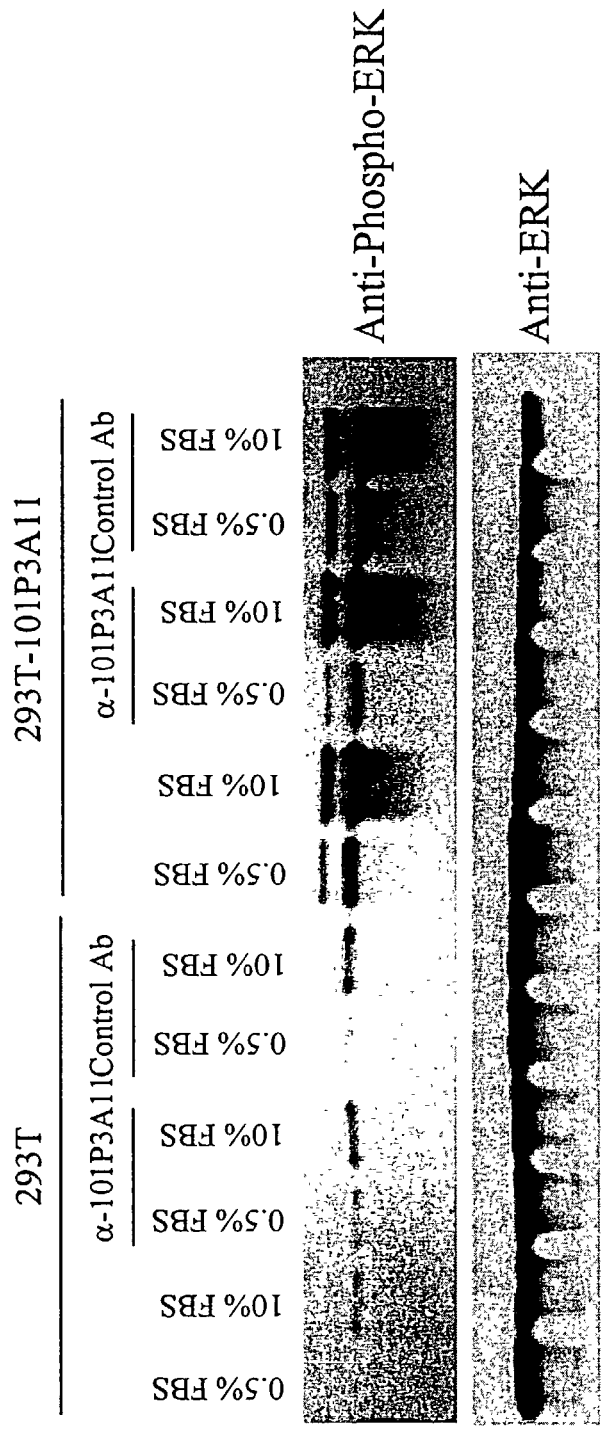
Figure 38: Inhibition of 101P3A11 Mediated ERK Phosphorylation by 101P3A11 Specific Antibodies
- Expression of 101P3A11 induced ERK phosphorylation in 293T cells.
- Anti-101P3A11 pAb inhibited ERK Phosphorylation in 293T-101P3A11 cells.

Figure 39: Anti-101P3A11 Ab Mediated cAMP Accumulation in PC3-101P3A11 Cells
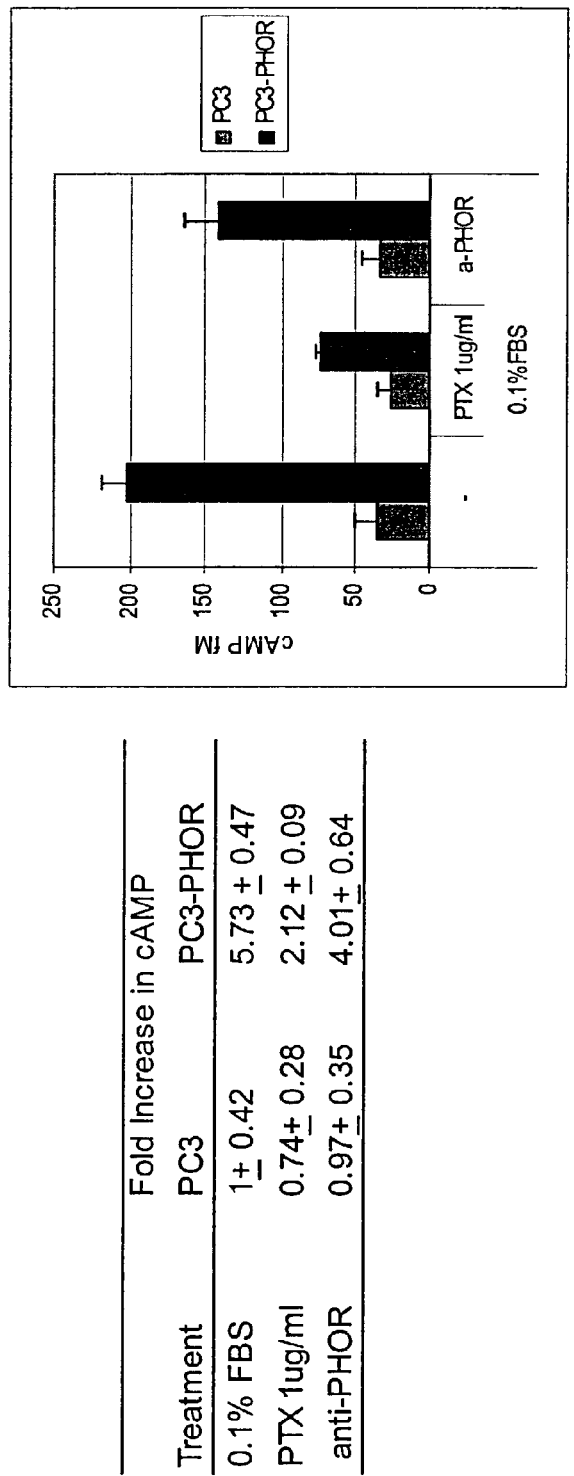
| Treatment | Fold Increase in cAMP | |
|---|---|---|
| | PC3 | PC3-PHOR |
| 0.1% FBS | 1 ± 0.42 | 5.73 ± 0.47 |
| PTX 1ug/ml | 0.74 ± 0.28 | 2.12 ± 0.09 |
| anti-PHOR | 0.97 ± 0.35 | 4.01 ± 0.64 |
- Control PC3 cells and cells expressing 101P3A11 were treated with anti-101P3A11 pAb for 2 min and evaluated for intracellular cAMP content.
- The assay was performed in duplicate.

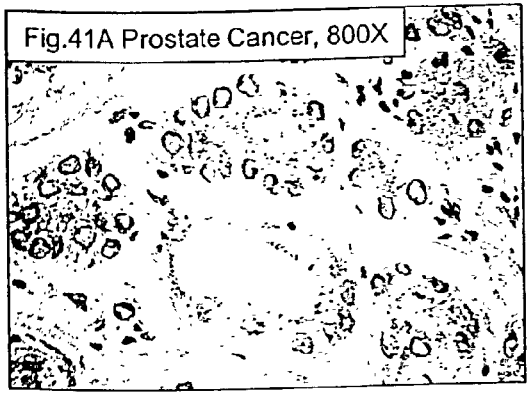
Fig.41A Prostate Cancer, 800X
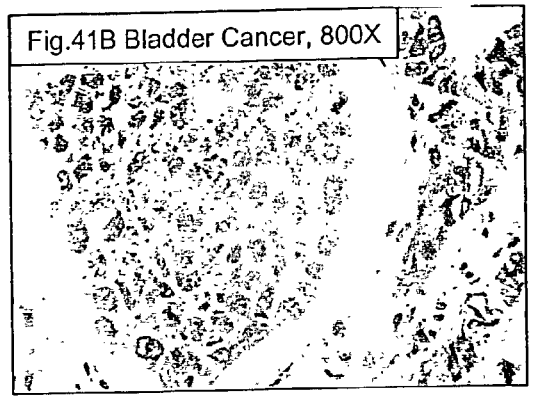
Fig.41B Bladder Cancer, 800X
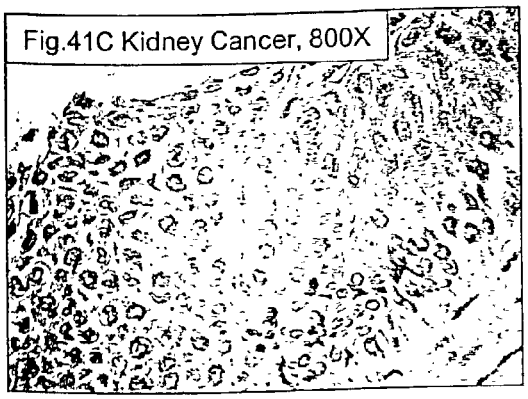
Fig.41C Kidney Cancer, 800X
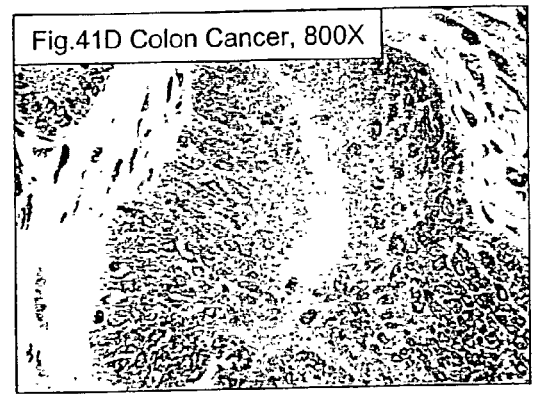
Fig.41D Colon Cancer, 800X
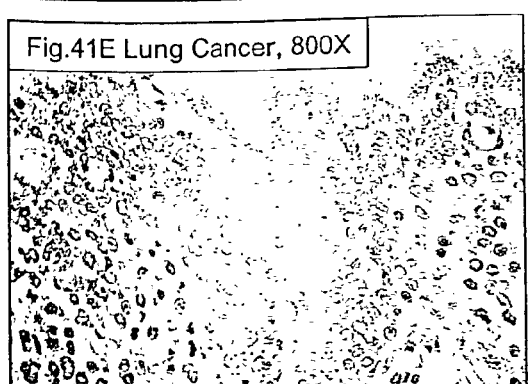
Fig.41E Lung Cancer, 800X
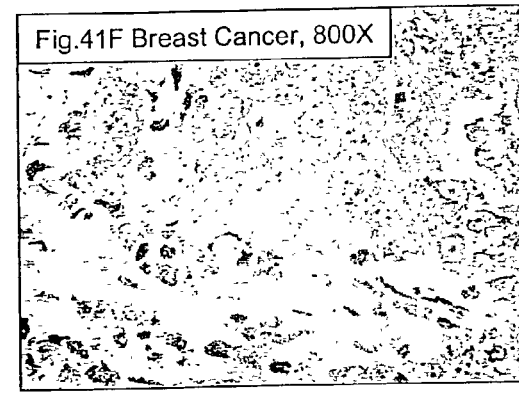
Fig.41F Breast Cancer, 800X

NUCLEIC ACID AND CORRESPONDING PROTEIN ENTITLED 101P3A41 USEFUL IN TREATMENT AND DETECTION OF CANCER

RELATED APPLICATIONS

This application claims benefit of priority from U.S. Provisional Application Ser. No. 60/291,118, filed May 15, 2001, now abandoned, and is a continuation-in-part of U.S. application Ser. No. 09/680,728, filed Oct. 5, 2000, now patented, U.S. Pat. No. 6,790,631, which claims benefit of priority from U.S. Provisional Application Ser. No. 60/157, 902, filed Oct. 5, 1999, now abandoned. All three of these applications are hereby incorporated in their entireties as if fully set forth.

SUBMISSION ON COMPACT DISC

The content of the following submission on compact discs is incorporated herein by reference in its entirety: A computer readable form (CRF) of the Sequence Listing on compact disc (file name: 511582002420, date recorded: Mar. 28, 2006, size: 583,680 bytes); a duplicate compact disc copy of the Sequence Listing (COPY 1) (file name: 511582002420, date recorded: Mar. 28, 2006, size: 583,680 bytes); and a duplicate compact disc copy of the Sequence Listing (COPY 2) (file name: 511582002420, date recorded: Mar. 28, 2006, size: 583,680 bytes).

FIELD OF THE INVENTION

The invention described herein relates to a novel gene and its encoded protein, termed 101P3A11, and to diagnostic and therapeutic methods and compositions useful in the management of various cancers that express 101P3A11 (also referred to as PHOR-1).

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445–51), STEAP (Hubert, et al., Proc Natl Acad Sci USA. 1999 Dec. 7; 96(25): 14523–8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and 8 per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992–1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992–1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992–1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992–1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 101P3A11, that is over-expressed in the normal tissues and cancers listed in Table I. Northern blot expression analysis of 101P3A11 gene expression in normal tissues shows a restricted expression pattern in adult tissues. The nucleotide (FIG. 2) and amino acid (FIG. 2, and FIG. 3) sequences of 101P3A11 are provided. The tissue-related profile of 101P3A11 in normal adult tissues, combined with the over-expression observed in tumors of the tissues listed in Table I, shows that 101P3A11 is aberrantly over-expressed in certain some cancers, and thus serves as a useful diagnostic, prophylactic, prognostic, and/or therapeutic target for cancers that express the protein, such as those listed in Table I.

The invention provides polynucleotides corresponding or complementary to all or part of the 101P3A11 genes, mRNAs, and/or coding sequences, preferably in isolated form, including polynucleotides encoding 101P3A11-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 101P3A11-related protein, as well as the peptides/proteins themselves; DNA, RNA, DNA/RNA hybrids, and related molecules, polynucleotides or oligonucleotides complementary or having at least a 90% homology to the 101P3A11 genes or mRNA sequences or parts thereof, and polynucleotides or oligonucleotides that hybridize to the 101P3A11 genes, mRNAs, or to 101P3A11-encoding polynucleotides. Also provided are means for isolating cDNAs and the genes encoding 101P3A11. Recombinant DNA molecules containing 101P3A11 polynucleotides, cells transformed or transduced with such molecules, and host-vector systems for the expression of 101P3A11 gene products are also provided. The invention further provides antibodies that bind to 101P3A11 proteins and polypeptide fragments thereof, including polyclonal and monoclonal antibodies, murine and other mammalian antibodies, chimeric antibodies, humanized and fully human antibodies, and antibodies labeled with a detectable marker. In certain embodiments there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 101P3A11 polynucleotides and proteins in various biological samples, as well as methods for identifying cells that express 101P3A11. A typical embodiment of this invention provides methods for monitoring 101P3A11 gene products in a tissue or hematology sample having or suspected of having some form of growth dys-regulation such as cancer.

The invention further provides various immunogenic or therapeutic compositions and strategies for treating cancers that express 101P3A11 such as cancers of tissues listed in Table I, including therapies aimed at inhibiting the transcription, translation, processing or function of 101P3A11 as well as cancer vaccines. In one aspect, the invention provides compositions, and methods comprising them, for treating a cancer that expresses 101P3A11 (PHOR-1) in a human subject wherein the composition comprises a carrier suitable for human use and a human unit dose of one or more than one agent that inhibits the production or function of 101P3A11 (PHOR-1). Preferably, the carrier is a uniquely human carrier. In another aspect of the invention, the agent is a moiety that is immunoreactive with 101P3A11 protein. Non-limiting examples of such moieties include, but are not limited to, antibodies (such as single chain, monoclonal, polyclonal, humanized, or human antibodies), functional equivalents thereof (whether naturally occurring or synthetic), and combinations thereof. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 101P3A11 and/or one or more than one peptide which comprises a helper T lymphocyte (HTL) epitope which binds an HLA class II molecule in a human to elicit an HTL response. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 101P3A11 as described above. The one or more than one nucleic acid molecule may also be, or encodes, a molecule that inhibits production of 101P3A11. Non-limiting examples of such molecules include, but are not limited to, those complementary to a nucleotide sequence essential for production of 101P3A11 (e.g. antisense sequences or molecules that form a triple helix with a nucleotide double helix essential for 101P3A11 production) or a ribozyme effective to lyse 101P3A11 mRNA.

BRIEF DESCRIPTION OF THE FIGURES

FIG. 1. 101P3A11 SSH sequence. The 101P3A11 SSH sequence is shown as SEQ ID NO: 2864.

FIGS. 2A–2D. The cDNA (SEQ ID. NO.: 2865) and amino acid sequence (SEQ ID. NO.: 2866) of 101P3A11. The start methionine is underlined. The open reading frame extends from nucleic acid 133 to 1086 including the stop codon (the codon for the initial M is omitted as the shorter peptide has a more favorable Kozak sequence).

FIG. 3. Amino acid sequence of 101P3A11 (SEQ ID. NO.: 2866). The 101P3A11 protein has 317 amino acids.

FIG. 4. Alignment of 101P3A11 (Sbjct—SEQ ID NO: 2867) with mouse olfactory receptor S25 (Query—SEQ ID NO: 2868.) The transmembrane regions of 101P3A11 and mouse olfactory receptor S25 (ORS25) predicted using the TMHMM algorithm are highlighted in gray. The amino acids of ORS25 predicted (Floriano, W. B., et al, 2000, Proc. Natl. Acad. Sci., USA, 97:10712–10716) to be involved in binding of the ligand hexanol and/or involved in the formation of the ligand binding pocket are italicized and bolded in the Figure, and are: Leu 131, Val 134, Val 135, Gly 138, Thr139, Ser 193, Ser 197, Phe 225, a 230, Ile 231, Gly 234, Thr 284, Phe 287, Gln 300, Lys 302.

FIG. 10A. Expression of 101P3A11 by RT-PCR. First strand cDNA was prepared from vital pool 1 (VP1: liver, lung and kidney), vital pool 2 (VP2, pancreas, colon and stomach), prostate xenograft pool, prostate cancer pool, kidney cancer pool, colon cancer pool, breast cancer pool, and cancer metastasis pool. Normalization was performed by PCR using primers to actin and GAPDH. Semi-quantitative PCR, using primers to 101P3A11, was performed at 30 cycles of amplification. Expression of 101P3A11 was observed in prostate xenograft pool, prostate cancer pool, kidney cancer pool, colon cancer pool, breast cancer pool, and cancer metastasis pool, but not in VP1 and VP2.

FIG. 11. Expression of 101P3A11 in human patient cancer specimens. RNA was extracted from a pool of three prostate cancer tumors, kidney cancer tumors, colon cancer tumors, breast cancer tumors, and a cancer metastasis pool derived from cancer patients, as well as from normal prostate (NP), normal bladder (NB), normal kidney (NK) and normal colon (NC). Northern blots with 10 μg of total RNA/lane were probed with a 101P3A11 fragment. Size standards in kilobases (kb) are indicated on the side. The results showed expression of 101P3A11 in prostate cancer tumors, kidney cancer tumors, colon cancer tumors, breast cancer tumors, cancer metastasis pool, bladder cancer pool, and in the normal prostate but not in the other normal tissues. A picture of the ethidium-bromide staining of the RNA gel is also presented.

FIG. 13. Expression of 101P3A11 in colon cancer patient specimens. RNA was extracted from colon tumors (T) and their normal adjacent tissues (Nat) derived from colon cancer patients. Northern blots with 10 μg of total RNA/lane were probed with 101P3A11 sequences. Size standards in kilobases (kb) are indicated on the side. Results showed expression of 101P3A11 in colon tumors but not in normal tissues. Expression was also seen in the colon cancer cell line T84. A picture of the ethidium-bromide staining of the RNA gel is also presented.

FIG. 14. Expression of 101P3A11 in kidney cancer patient specimens. RNA was extracted from kidney tumors (T) and their normal adjacent tissues (Nat) derived from kidney cancer patients. Northern blots with 10 μg of total RNA/lane were probed with 101P3A11 sequences. Size standards in kilobases (kb) are indicated on the side. The results showed expression of 101P3A11 in five of six kidney tumor specimens. The expression detected in normal adjacent tissues (isolated from diseased tissues) but not in normal tissues (isolated from healthy donors) indicates that these tissues are not fully normal and that 101P3A11 is expressed in early stage tumors. A picture of the ethidium-bromide staining of the RNA gel is also presented.

FIGS. 15A–15C. Androgen regulation of 101P3A11 in tissue culture cells. LAPC-9 cells were grown in charcoal-stripped medium and stimulated with the synthetic androgen mibolerone, for either 14 or 24 hours. Northern blots with 10 μg of total RNA/lane were probed with 101P3A11 sequences (FIG. 15A). A picture of the ethidium-bromide staining of the RNA gel is also presented (FIG. 15C). Results showed expression of 101P3A11 was not regulated by androgen. The experimental samples were confirmed by testing for the expression of the androgen-regulated prostate cancer gene PSA (FIG. 15N). This experiment showed that, as expected, PSA levels go down in presence of charcoal-stripped serum, and expression is induced at 14 and 24 hours in presence of mibolerone.

FIG. 16. Androgen regulation of 101P3A11 in vivo. Male mice were injected with LAPC-9AD tumor cells. When tumors reached a palpable size (0.3–0.5 cm in diameter), mice were castrated and tumors harvested at different time points following the castration. RNA was isolated from the xenograft tissues. Northern blots with 10 μg of total RNA/lane were probed with 101P3A11 sequences. Size standards in kilobases (kb) are indicated on the side. A picture of the ethidium-bromide staining of the RNA gel is also presented. The results showed that expression of 101P3A11 is not androgen regulated.

FIG. 17. Expression and detection of 101P3A11 (159–202)-psecFc fusion protein. The 101P3A11(159–202)-psecFc vector was constructed. The recombinant expression vector DNA was transfected into either 293T cells or Cos-7 cells. Cells as well as culture supernatants (media) were harvested 24 hours later. The cells were lysed, and run on SDS-PAGE gel along with the media samples. The gel was transferred to nitrocellulose, stained with HRP-labeled anti-human IgG and developed using the ECL chemiluminescence detection kit. Results showed expression of the 101P3A11(159–202)-psecFc fusion protein in the lysates of both 293T and Cos-7 cells. The 101P3A11(159–202)-psecFc fusion protein was also secreted and detected in the culture supernatants of both cell types.

FIG. 18. Expression of 101P3A11 in 300.19 cells following retroviral-mediated gene delivery. 300.19 cells were transduced with the pSRα retroviral vector encoding the 101P3A11 gene. Following selection with neomycin, the cells were expanded and RNA was extracted. A Northern blot with 10 μg of total RNA/lane was probed with the 101P3A11 sequence. Size standards in kilobases (kb) are indicated on the side. Results showed expression of the 101P3A11 transcript driven from the retroviral LTR. LAPC-4AD and LAPC-9AD showed expression of the endogenous 101P3A11 transcript. The figure shows results of a short exposure of the autoradiogram.

FIGS. 19A–19C. Secondary structure and transmembrane prediction for 101P3A11 (SEQ ID NO: 2866). FIG. 19A: The secondary structure of 101P3A11 protein was predicted using the HNN—Hierarchical Neural Network method (Guermeur, 1997, http://pbil.ibcp.fr/cgi-bin/npsa_automat.pl?page=npsa_nn.html), accessed from the ExPasy molecular biology server (http://www.expasy.ch/tools/). This method predicts the presence and location of alpha helices, extended strands, and random coils from the primary protein sequnce. The percent of the protein in a given secondary structure is also given. FIG. 19B is a schematic representation of the probability of existence of transmembrane regions and orientation of 101P3A11 based on the TMpred algorithm of Hofmann and Stoffel which utilizes TMBASE (K. Hofmann, W. Stoffel. TMBASE—A database of membrane spanning protein segments Biol. Chem. Hoppe-Seyler 374:166, 1993). FIG. 19C is a schematic representation of the probability of the existence of transmembrane regions and the extracellular and intracellular orientation of 101P3A11 based on the TMHMM algorithm of Sonnhammer, von Heijne, and Krogh (Erik L. L. Sonnhammer, Gunnar von Heijne, and Anders Krogh: A hidden Markov model for predicting transmembrane helices in protein sequences. In Proc. of Sixth Int. Conf. on Intelligent Systems for Molecular Biology, p 175–182 Ed J. Glasgow, T. Littlejohn, F. Major, R. Lathrop, D. Sankoff, and C. Sensen Menlo Park, Calif.: AAAI Press, 1998). The TMpred and TMHMM algorithms are accessed from the ExPasy molecular biology server (http://www.expasy.ch/tools/). The results of the transmembrane prediction programs presented in FIGS. 19B and 19C depict 101P3A11 as containing 7 transmembrane domains consistent with that of a G-protein coupled receptor.

FIG. 20. Expression of 101P3A11 in NIH-3T3 Tumors. Mice were injected subcutaneously with control 3T3-neo or NIH3T3 cells expressing 101P3A11. Tumors were allowed to grow, the mice were then sacrificed and tumors harvested. RNA was isolated from LAPC-4AD and LAPC-4AI xenografts, 3T3-neo and 3T3-101P3A11 cells grown in culture were used as controls. RNA isolated from six different tumors derived from 3T3-101P3A11 cells (Tumor #1–3) were compared by Northern blotting. Northern blots with 10 μg of total RNA/lane were probed with 101P3A11 sequence. A picture of the ethidium-bromide staining of the RNA gel is also presented. Results showed expression of 101P3A11 in all 3T3-101P3A11 tumors as well as in 3T3/101P3A11 cells used to derive the tumors, but not in the negative control cells 3T3/neo cells.

FIG. 21. 101P3A11 Induces Tumor Formation of 3T3 Cells. Injection of 106 3T3-neo, 3T3-Ras or 3T3-101P3A11 cells (106 of the indicated cells mixed with Matrigel) subcutaneously into 6 male SCID mice (right flank) revealed that 6/6 3T3-v12Ras-injected mice formed tumors, 6/6 3T3-101P3A11-injected mice formed tumors, and 0/6 3T3-neo-injected mice formed tumors. Each data point represents the mean tumor volume (n=6) in each group.

FIG. 22. PTX reduces the in vivo growth of 3T3-101P3A11 Tumors. Pertussis toxin was found to inhibit the sub-cutaneous growth of 3T3-101P3A11 tumors in SCID mice in a dose dependent manner.

FIG. 23. Alignment of 101P3A11-PHOR-1 (Phor—SEQ ID NO: 2869) with the rat GPCR RA1C—SEQ ID NO: 2870 (gi|3420759). Identities=179/299 (59%), Positives=231/299 (76%), Gaps=1/299 (0%).

FIG. 24. Alignment of 101P3A11-PHOR-1 (Phor—SEQ ID NO: 2871) with the human prostate specific GPCR-SEQ ID NO: 2872 (gi|13540539). Identities=179/299 (59%), Positives=233/299 (77%), Gaps=1/299 (0%).

FIG. 25. Alignment of 101P3A11-PHOR-1 (Phor—SEQ ID NO: 2873) with human olfactory receptor 51I12, HOR5—SEQ ID NO: 2874, (gi|14423836). Identities=163/304 (53%), Positives=214/304 (69%), Gaps=1/304 (0%).

FIG. 26. 101P3A11 Modulated Tyrosine Phosphorylation in NIH-3T3 Cells. 101P3A11 mediated the de-phosphorylation of proteins at 200, 120–140, 85–90 and 55 kDa. 101P3A11 induced the phosphorylation of proteins at 80 and 29 kDa in NIH-3T3 cells.

FIG. 27. ERK Phosphorylation by PCR ligands in 101P3A11 Expressing Cells. FBS, lipophosphatidic acid, gastrin releasing peptide, leukotriene and platelet activating factor induced the phosphorylation of ERK in 101P3A11 expressing cells.

FIG. 28. Inhibition of 101P3A11-Mediated ERK Activation by PD98059. ERK phosphorylation was inhibited by a MEK specific (PD98059) but not a p38 specific (SB203580) inhibitor in PC3-101P3A11 cells.

FIG. 29. Enhanced ERK Phosphorylation in Sodium Orthovanadate Treated PC3-101P3A11 Cells. Sodium orthovanadate induced increased ERK phosphorylation in PC3-101P3A11 cells relative to PC3-neo cells.

FIG. 30. Inhibition of 101P3A11-Mediated ERK Phosphorylation by AG1517. The EGFR inhibitor, AG1517, inhibits EGF-mediated ERK phosphorylation in control and 101P3A11-expressing PC3 cells. AG1517 partially inhibits 101P3A11 mediated ERK phosphorylation in PC3 cells.

FIGS. 31A–31B. Activation of p38 in PC3-101P3A11 Cells. Expression of 101P3A11 mediates p38 phosphorylation in cells treated with 10% FBS as shown by blotting with antibodies to phospho-p38 (FIG. 31A) compared to p38 (FIG. 31B).

FIG. 32. 101P3A11 Induced Accumulation of cAMP in PC3 Cells. Expression of 101P3A11 increased the accumulation of cAMP in cells treated with 0.1% and 10% FBS. FBS-induced cAMP accumulation in 101P3A11 cells was inhibited by pertussis toxin.

FIG. 33. Pertussis Toxin Inhibits 101P3A11 Mediated ERK Phosphorylation. Pertussis toxin inhibited FBS-mediated ERK phosphorylation in 101P3A11 expressing cells.

FIG. 34. Pertussis Toxin Inhibited ERK Phosphorylation in PC3-101P3A11 Cells. Pertussis toxin inhibited FBS-mediated ERK phosphorylation in 101P3A11 expressing cells. The inhibitory activity of pertussis toxin on ERK phosphorylation was more dramatic in FBS-treated than EGF or GRP-treated PC3-101P3A11 cells FIG. 35. Inhibition of 101P3A11-mediated signaling by Suranim, a G protein inhibitor. Control NIH 3T3 and 3T3-101P3A11 cells were grown in the presence of absence of G protein inhibitors Surinam and NF449. Proliferation was analyzed by Alamar blue after 72 hours. Suranim and NF449 inhibited the proliferation of 101P3A11 expressing but not control cells.

FIGS. 36A–36B. 101P3A11Mediated ERK Phosphorylation By Conditioned Media. FIG. 36A: blotting with anti-phospho ERK antibodies; FIG. 36B: blotting with anti-ERK antibodies. Supernatants from PC3, PC3-101P3A11, PrEC and LAPC42 cells induce ERK phosphorylation in PC3-101P3A11 but not PC3 cells. Supernantants from 3T3 and 293T cells had little specific effect on ERK phosphorylation.

FIG. 37. 101P3A11 Enhances the Proliferation of 3T3 Cells. Control NIH 3T3 and 3T3-101P3A11 cells were grown in the presence of absence 0.5 or 10% FBS. Proliferation was analyzed by Alamar blue after 48 hours. Expression of 101P3A11 induced a 6 fold increase in the proliferation of 3T3 cells grown in 0.5% FBS.

FIG. 38. Inhibition of 101P3A11 Mediated ERK Phosphorylation by 101P3A11 Specific Antibodies. Expression of 101P3A11 induced ERK phosphorylation in 293T cells. Anti-101P3A11 pAb inhibited ERK Phosphorylation in 293T-101P3A11 cells.

FIG. 39. Anti-101P3A11 Ab Mediated cAMP Accumulation in PC3-b 101P3A11 Cells. Control PC3 cells and cells expressing 101P3A11 were treated with anti-101P3A11 pAb for 2 min and evaluated for intracellular cAMP content. The assay was performed in duplicate.

FIGS. 41A–41F. Photomicrographs showing immunohistochemical analysis using anti-101P3A11 (peptide 1; amino acids 1–14) rabbit polyclonal antibody on formalin fixed and paraffin embedded prostate cancer tissues (FIG. 41A); anti-101P3A11 (peptide 1; amino acids 1–14) rabbit polyclonal antibody on formalin fixed and paraffin embedded bladder cancer tissues (FIG. 41B); anti-101P3A11 (peptide 1; amino acids 1–14) rabbit polyclonal antibody on formalin fixed and paraffin embedded kidney cancer tissues (FIG. 41C); anti-101P3A11 (peptide 1; amino acids 1–14) rabbit polyclonal antibody on formalin fixed and paraffin embedded colon cancer tissues (FIG. 41D); anti-101P3A11 (peptide 1; amino acids 1–14) rabbit polyclonal antibody on formalin fixed and paraffin embedded lung cancer tissues (FIG. 41E); and anti-101P3A11 (peptide 1; amino acids 1–14) rabbit polyclonal antibody on formalin fixed and paraffin embedded breast cancer tissues (FIG. 41F).

DETAILED DESCRIPTION OF THE INVENTION

Figure 5:
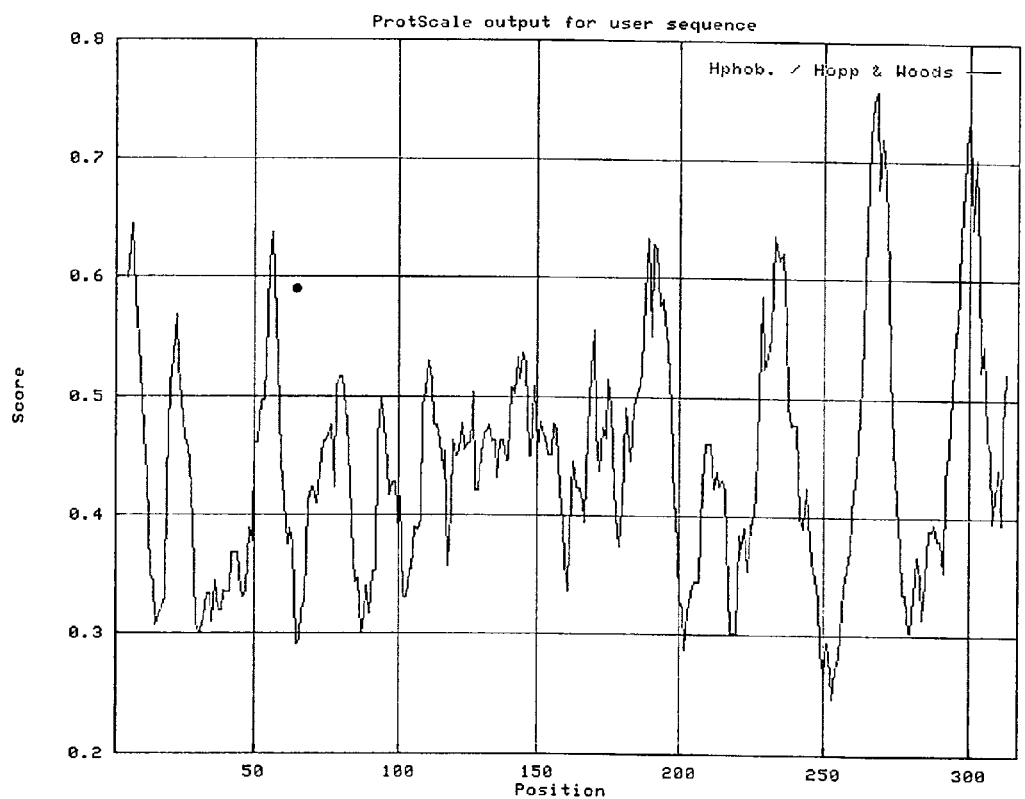
FIG. 5. Hydrophilicity amino acid profile of 101P3A11 determined by computer algorithm sequence analysis using the method of Hopp and Woods (Hopp T. P., Woods K. R., 1981. Proc. Natl. Acad. Sci. U.S.A. 78:3824–3828) accessed on the Protscale website (www.expasy.ch/cgi-bin/protscale.pl) through the ExPasy molecular biology server.

Outline of Sections
I.) Definitions
II.) 101P3A11 Polynucleotides
II.A.) Uses of 101P3A11 Polynucleotides
   II.A.1.) Monitoring of Genetic Abnormalities
   II.A.2.) Antisense Embodiments
   II.A.3.) Primers and Primer Pairs
   II.A.4.) Isolation of 101P3A11-Encoding Nucleic Acid Molecules
   II.A.5.) Recombinant Nucleic Acid Molecules and Host-Vector Systems
III.) 101P3A11-related Proteins
III.A.) Motif-bearing Protein Embodiments
III.B.) Expression of 101P3A11-related Proteins
III.C.) Modifications of 101P3A11-related Proteins
III.D.) Uses of 101P3A11-related Proteins
IV.) 101P3A11 Antibodies
V.) 101P3A11 Cellular Immune Responses
VI.) 101P3A11 Transgenic Animals
VII.) Methods for the Detection of 101P3A11
VII.) Methods for Monitoring the Status of 101P3A11-related Genes and Their Products
IX.) Identification of Molecules That Interact With 101P3A11
X.) Therapeutic Methods and Compositions
X.A.) Anti-Cancer Vaccines
X.B.) 101P3A11 as a Target for Antibody-Based Therapy
X.C.) 101P3A11 as a Target for Cellular Immune Responses
   X.C.1. Minigene Vaccines
   X.C.2. Combinations of CTL Peptides with Helper Peptides
   X.C.3. Combinations of CTL Peptides with T Cell Priming Agents
   X.C.4. Vaccine Compositions Comprising DC Pulsed with CTL and/or HTL Peptides
X.D.) Adoptive Immunotherapy
X.E.) Administration of Vaccines for Therapeutic or Prophylactic Purposes
XI.) Diagnostic and Prognostic Embodiments of 101P3A11.
XII.) Inhibition of 101P3A11 Protein Function
   XII.A.) Inhibition of 101P3A11 With Intracellular Antibodies
   XII.B.) Inhibition of 101P3A11 with Recombinant Proteins
   XII.C.) Inhibition of 101P3A11 Transcription or Translation
   XII.D.) General Considerations for Therapeutic Strategies
XIII.) KITS
I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1–C2 disease under the Whitmore-Jewett system, and stage T3–T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 101P3A11 (either by removing the underlying glycosylation site or by deleting the glycosylation by chemical and/or enzymatic means), and/or adding one or more glycosylation sites that are not present in the native sequence 101P3A11. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 101P3A11-related protein). For example an analog of the 101P3A11 protein can be specifically bound by an antibody or T cell that specifically binds to 101P3A11.

The term "antibody" is used in the broadest sense. Therefore an "antibody" can be naturally occurring or man-made such as monoclonal antibodies produced by conventional hybridoma technology. Anti-101P3A11 antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-101P3A11 antibodies and clones thereof (including agonist, antagonist and neutralizing antibodies) and anti-101P3A11 antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

The term "cytotoxic agent" refers to a substance that inhibits or prevents the function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to maytansinoids, yttrium, bismuth, ricin, ricin A-chain, doxorubicin, daunorubicin, taxol, ethidium bromide, mitomycin, etoposide, tenoposide, vincristine, vinblastine, colchicine, dihydroxy anthracin dione, actinomycin, diphtheria toxin, *Pseudomonas* exotoxin (PE) A, PE40, abrin, abrin A chain, modeccin A chain, alphasarcin, gelonin, mitogellin, retstrictocin, phenomycin, enomycin, curicin, crotin, calicheamicin, sapaonaria officinalis inhibitor, and glucocorticoid and other chemotherapeutic agents, as well as radioisotopes such as $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu. Antibodies may also be conjugated to an anti-cancer pro-drug activating enzyme capable of converting the prodrug to its active form.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/ 100 μg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 101P3A11 gene or that encode polypeptides other than 101P3A11 gene product or fragments thereof A skilled artisan can readily employ nucleic acid isolation procedures to obtain an isolated 101P3A11 polynucleotide. A protein is said to be "isolated," for example, when physical, mechanical or chemical methods are employed to remove the 101P3A11 protein from cellular constituents that are normally associated with the protein. A skilled artisan can readily employ standard purification methods to obtain an isolated 101P3A11 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage TxNxM+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of an 101P3A11-related protein, refers to any pattern of amino acids forming part of the primary sequence of a protein, that is associated with a particular function (e.g. protein—protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T) (as shown for example in SEQ ID NO: 702) can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. In another embodiment, for example, the primary anchor residues of a peptide that will bind an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

A "recombinant" DNA or RNA molecule is a DNA or RNA molecule that has been subjected to molecular manipulation in vitro.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium.citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/mL denatured sheared salmon sperm DNA, followed by washing the filters in 1×SSC at about 37–50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles.

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1–150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

The term "variant" refers to a molecule that exhibits a variation from a described type or norm, such as a protein that has one or more different amino acid residues in the corresponding position(s) of a specifically described protein (e.g. the 101P3A11 protein shown in FIG. 2 or FIG. 3). An analog is an example of a variant protein.

The 101P3A11-related proteins of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 101P3A11 proteins or fragments thereof, as well as fusion proteins of a 101P3A11 protein and a heterologous polypeptide are also included. Such 101P3A11 proteins are collectively referred to as the 101P3A11-related proteins, the proteins of the invention, or 101P3A11. The term "101P3A11-related protein" refers to a polypeptide fragment or an 101P3A11 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100 or more than 100 amino acids.

II.) 101P3A11 Polynucleotides

One aspect of the invention provides polynucleotides corresponding or complementary to all or part of an 101P3A11 gene, mRNA, and/or coding sequence, preferably in isolated form, including polynucleotides encoding an 101P3A11-related protein and fragments thereof, DNA, RNA, DNA/RNA hybrid, and related molecules, polynucleotides or oligonucleotides complementary to an 101P3A11 gene or mRNA sequence or a part thereof, and polynucleotides or oligonucleotides that hybridize to an 101P3A11 gene, mRNA, or to an 101P3A11 encoding polynucleotide (collectively, "101P3A11 polynucleotides"). In all instances when referred to in this section, T can also be U in FIG. 2.

Figure 6:
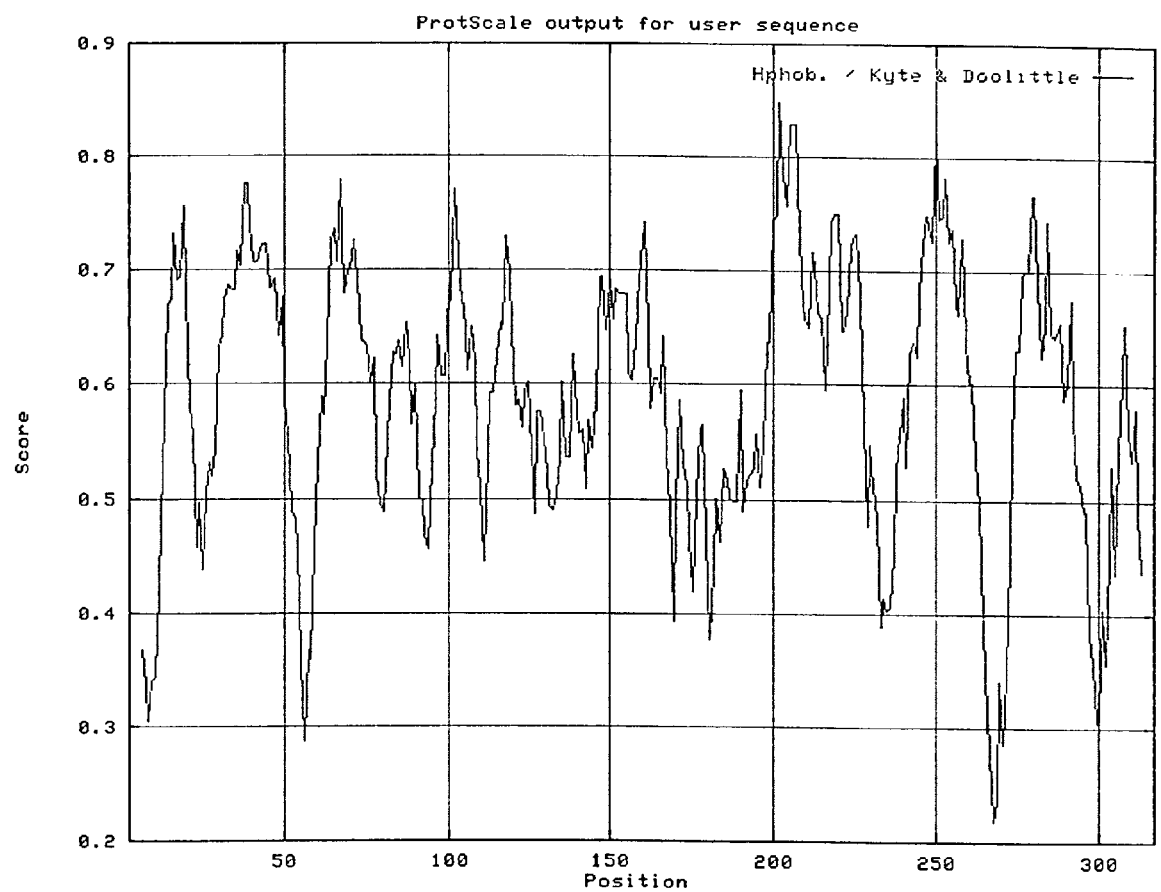
FIG. 6. Hydropathicity amino acid profile of 101P3A11 determined by computer algorithm sequence analysis using the method of Kyte and Doolittle (Kyte J., Doolittle R. F., 1982. J. Mol. Biol. 157:105–132) accessed on the ProtScale website (www.expasy.ch/cgi-bin/protscale.pl) through the ExPasy molecular biology server.
Figure 7:
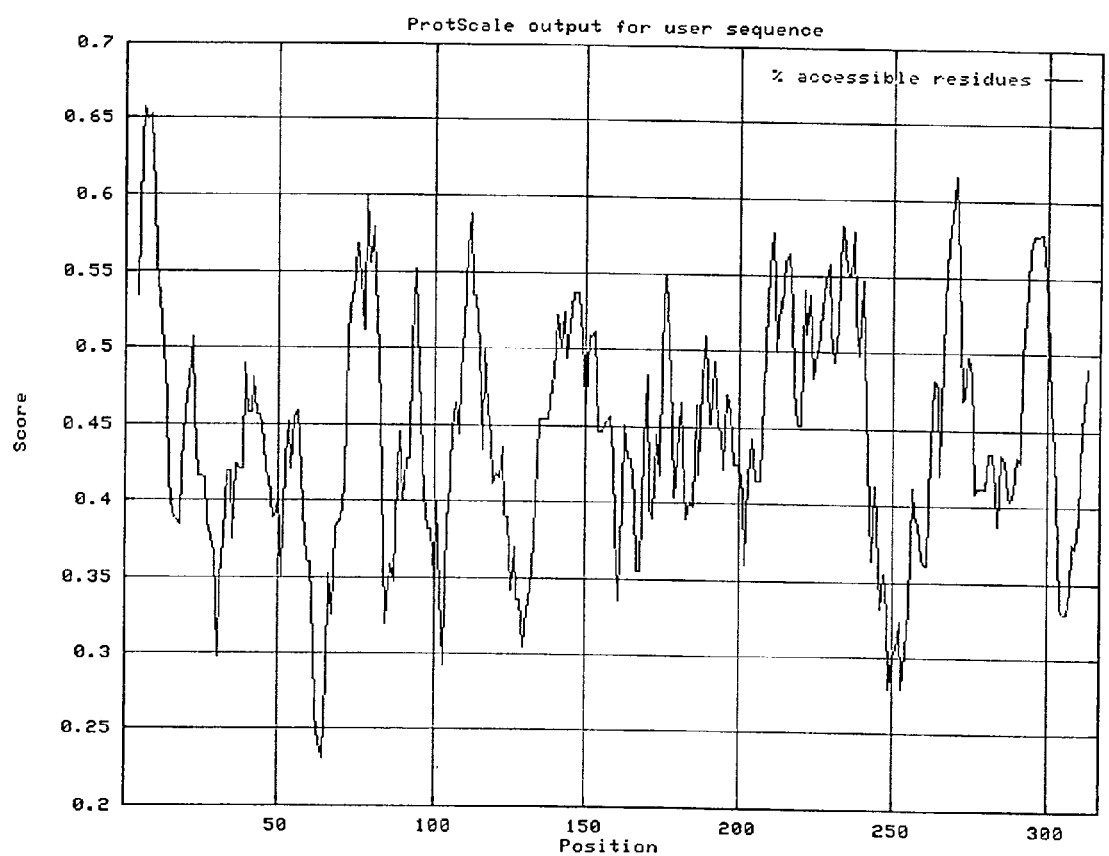
FIG. 7. Percent accessible residues amino acid profile of 101P3A11 determined by computer algorithm sequence analysis using the method of Janin (Janin J., 1979 Nature 277:491–492) accessed on the ProtScale website (www.expasy.ch/cgi-bin/protscale.pl) through the ExPasy molecular biology server.
Figure 8:
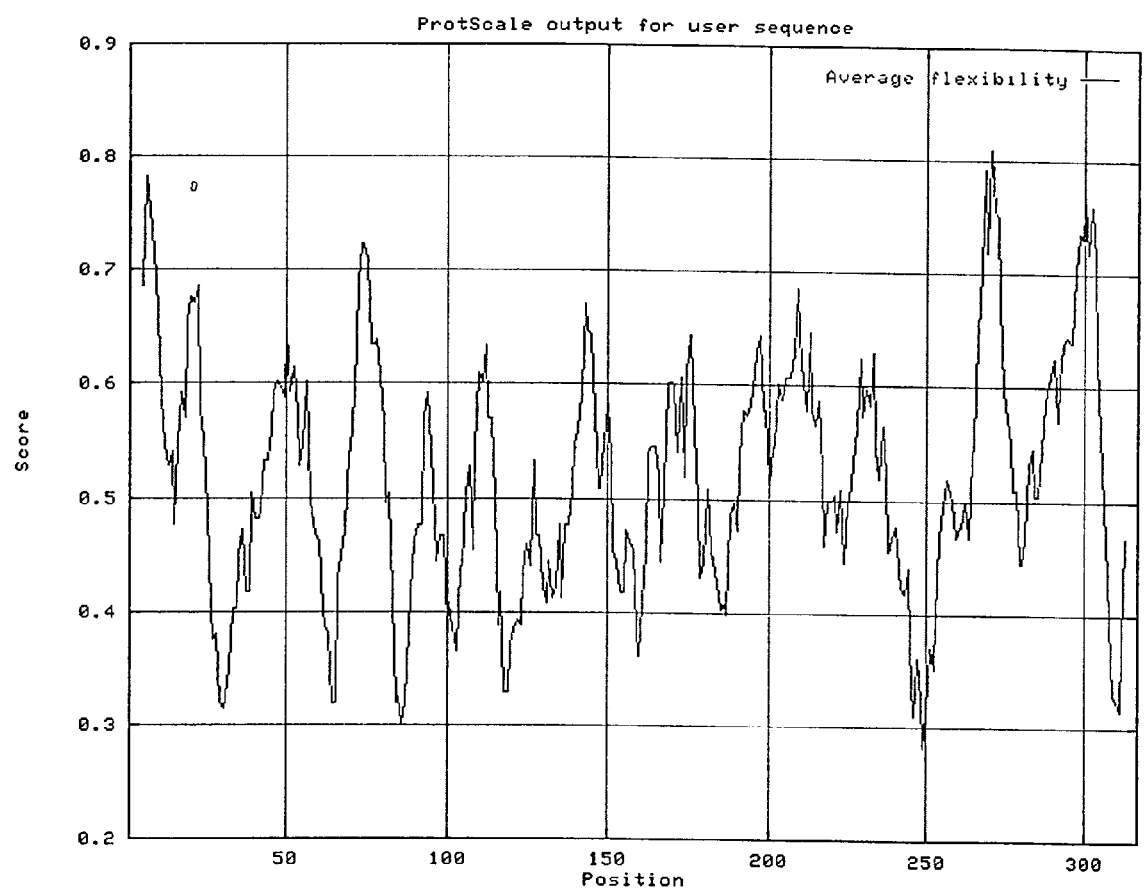
FIG. 8. Average flexibility amino acid profile of 101P3A11 determined by computer algorithm sequence analysis using the method of Bhaskaran and Ponnuswamy (Bhaskaran R., and Ponnuswamy P. K., 1988. Int. J. Pept. Protein Res. 32:242–255) accessed on the ProtScale website (www.expasy.ch/cgi-bin/protscale.pl) through the ExPasy molecular biology server.
Figure 9:
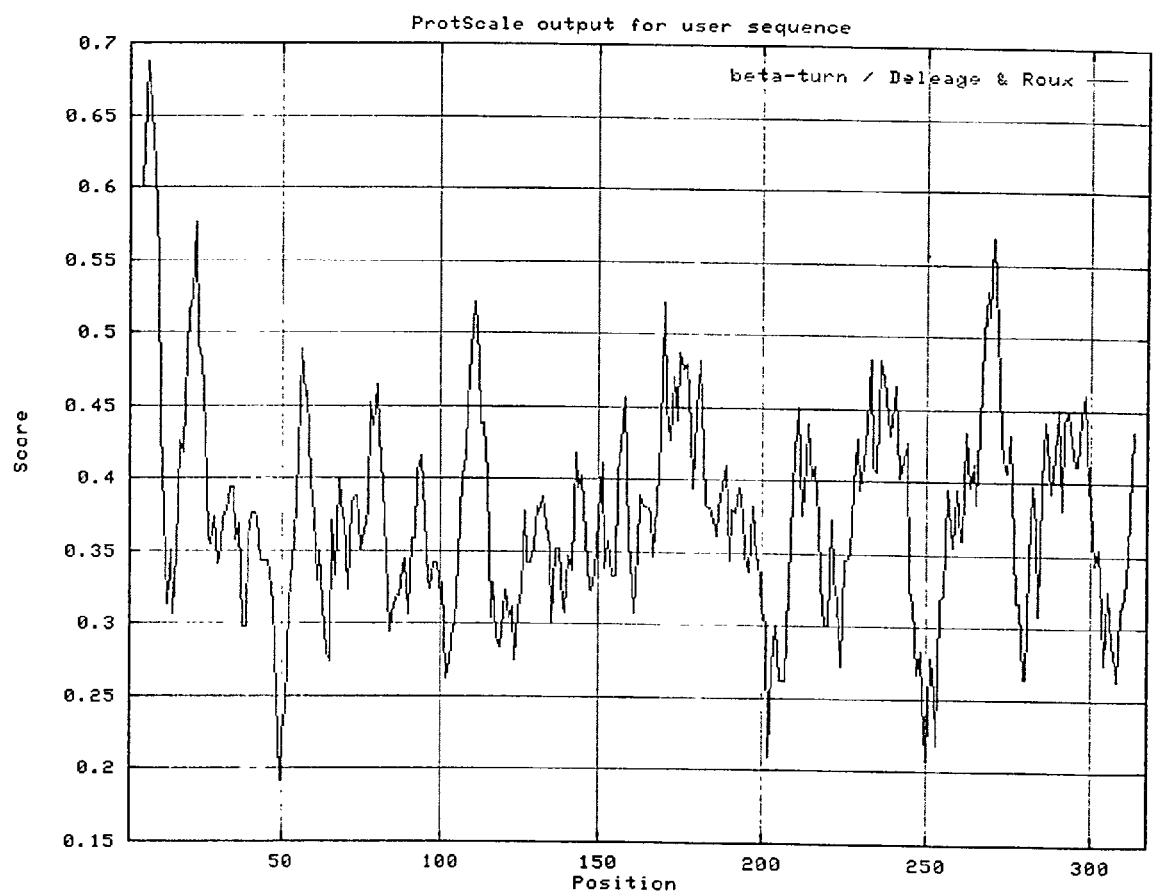
FIG. 9. Beta-turn amino acid profile of 101P3A11 determined by computer algorithm sequence analysis using the method of Deleage and Roux (Deleage, G., Roux B. 1987 Protein Engineering 1:289–294) accessed on the ProtScale website (www.expasy.ch/cgi-bin/protscale.pl) through the ExPasy molecular biology server.

Embodiments of a 101P3A11 polynucleotide include: a 100P3A11 polynucleotide having the sequence shown in FIG. 2, the nucleotide sequence of 101P3A11 as shown in FIG. 2, wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 101P3A11 nucleotides comprise, without limitation:

(a) a polynucleotide comprising, consisting essentially of, or consisting of the sequence as shown in FIG. 2 (SEQ ID NO.: 2865), wherein T can also be U;

(b) a polynucleotide comprising, consisting essentially of, or consisting of the sequence as shown in FIG. 2 (SEQ ID NO.: 2865), from nucleotide residue number 133 through nucleotide residue number 1086, wherein T can also be U;

(c) a polynucleotide that encodes a 101P3A11-related protein whose sequence is encoded by the cDNAs contained in the plasmid designated p101P3A11, clone GTH10 deposited with American Type Culture Collection as Accession No. PTA-312 on Jul. 2, 1999;

(d) a polynucleotide that encodes an 101P3A11-related protein that is at least 90% homologous to the entire amino acid sequence shown in FIG. 2 (SEQ ID NO.: 2866);

(e) a polynucleotide that encodes an 101P3A11-related protein that is at least 90% identical to the entire amino acid sequence shown in FIG. 2 (SEQ ID NO: 2866);

(f) a polynucleotide that encodes at least one peptide set forth in Tables V–XVIII or XXVI–XXVIII;

(g) a polynucleotide that encodes a peptide region of at least 5 amino acids of FIG. 3 in any whole number increment up to 317 that includes an amino acid position having a value greater than 0.5 in the Hydrophilicity profile of FIG. 5;

(h) a polynucleotide that encodes a peptide region of at least 5 amino acids of FIG. 3 in any whole number increment up to 317 that includes an amino acid position having a value less than 0.5 in the Hydropathicity profile of FIG. 6;

(i) a polynucleotide that encodes a peptide region of at least 5 amino acids of FIG. 3 in any whole number increment up to 317 that includes an amino acid position having a value greater than 0.5 in the Percent Accessible Residues profile of FIG. 7;

(j) a polynucleotide that encodes a peptide region of at least 5 amino acids of FIG. 3 in any whole number increment up to 317 that includes an amino acid position having a value greater than 0.5 in the Average Flexibility profile on FIG. 8;

(k) a polynucleotide that encodes a peptide region of at least 5 amino acids of FIG. 3 in any whole number increment up to 317 that includes an amino acid position having a value greater than 0.5 in the Beta-turn profile of FIG. 9;

(l) a polynucleotide that is fully complementary to a polynucleotide of any one of (a)–(k);

(m) a polynucleotide that selectively hybridizes under stringent conditions to a polynucleotide of (a)–(l);

(n) a peptide that is encoded by any of (a)–(k); and, (o) a polynucleotide of any of (a)–(m) or peptide of (n) together with a pharmaceutical excipient and/or in a human unit dose form.

As used herein, a range is understood to specifically disclose all whole unit positions thereof.

Typical embodiments of the invention disclosed herein include 101P3A11 polynucleotides that encode specific portions of the 101P3A11 mRNA sequence (and those which are complementary to such sequences) such as those that encode the protein and fragments thereof, for example of 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 250, 275, 300, or 317 contiguous amino acids.

For example, representative embodiments of the invention disclosed herein include: polynucleotides and their encoded peptides themselves encoding about amino acid 1 to about amino acid 10 of the 101P3A11 protein shown in FIG. 2 or FIG. 3, polynucleotides encoding about amino acid 10 to about amino acid 20 of the 101P3A11 protein shown in FIG. 2, or FIG. 3, polynucleotides encoding about amino acid 20 to about amino acid 30 of the 101P3A11 protein shown in FIG. 2 or FIG. 3, polynucleotides encoding about amino acid 30 to about amino acid 40 of the 101P3A11 protein shown in FIG. 2 or FIG. 3, polynucleotides encoding about amino acid 40 to about amino acid 50 of the 101P3A11 protein shown in FIG. 2 or FIG. 3, polynucleotides encoding about amino acid 50 to about amino acid 60 of the 101P3A11 protein shown in FIG. 2 or FIG. 3, polynucleotides encoding about amino acid 60 to about amino acid 70 of the 101P3A11 protein shown in FIG. 2 or FIG. 3, polynucleotides encoding about amino acid 70 to about amino acid 80 of the 101P3A11 protein shown in FIG. 2 or FIG. 3, polynucleotides encoding about amino acid 80 to about amino acid 90 of the 101P3A11 protein shown in FIG. 2 or FIG. 3, polynucleotides encoding about amino acid 90 to about amino acid 100 of the 101P3A11 protein shown in FIG. 2 or FIG. 3, in increments of about 10 amino acids, ending at the carboxyl terminal amino acid set forth in FIG. 2 or FIG. 3. Accordingly polynucleotides encoding portions of the amino acid sequence (of about 10 amino acids), of amino acids 100 through the carboxyl terminal amino acid of the 101P3A11 protein are embodiments of the invention.

Wherein it is understood that each particular amino acid position discloses that position plus or minus five amino acid residues.

Polynucleotides encoding relatively long portions of the 101P3A11 protein are also within the scope of the invention. For example, polynucleotides encoding from about amino acid 1 (or 20 or 30 or 40 etc.) to about amino acid 20, (or 30, or 40 or 50 etc.) of the 101P3A1100 protein shown in FIG. 2 or FIG. 3 can be generated by a variety of techniques well known in the art. These polynucleotide fragments can include any portion of the 101P3A11 sequence as shown in FIG. 2 or FIG. 3.

Additional illustrative embodiments of the invention disclosed herein include 101P3A11 polynucleotide fragments encoding one or more of the biological motifs contained within the 101P3A11 protein sequence, including one or more of the subsequences of the 101P3A11 protein set forth in Tables V–XVIII or XXVI–XXVIII. In another embodiment, typical polynucleotide fragments of the invention encode one or more of the regions of 101P3A11 that exhibit homology to a known molecule. In another embodiment of the invention, typical polynucleotide fragments can encode one or more of the 101P3A11 N-glycosylation sites, cAMP and cGMP-dependent protein kinase phosphorylation sites, casein kinase II phosphorylation sites or N-myristoylation site and amidation sites.

II.A.) Uses of 101P3A11 Polynucleotides

II.A.1.) Monitoring of Genetic Abnormalities

The polynucleotides of the preceding paragraphs have a number of different specific uses. The human 101P3A11 gene maps to the chromosomal location set forth in Table XXV. For example, because the 101P3A11 gene maps to this chromosome, polynucleotides that encode different regions of the 101P3A11 protein are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(34): 81–83 (1998); Johansson et al., Blood 86(10): 3905–3914 (1995) and Finger et al., P.N.A.S. 85(23): 9158–9162 (1988)). Thus, polynucleotides encoding specific regions of the 101P3A11 protein provide new tools that can be used to delineate, with greater precision than previously possible, cytogenetic abnormalities in the chromosomal region that encodes 101P3A11 that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055–1057 (1994)).

Furthermore, as 101P3A11 was shown to be highly expressed in prostate and other cancers, 101P3A11 polynucleotides are used in methods assessing the status of 101P3A11 gene products in normal versus cancerous tissues. Typically, polynucleotides that encode specific regions of the 101P3A11 protein are used to assess the presence of perturbations (such as deletions, insertions, point mutations, or alterations resulting in a loss of an antigen etc.) in specific regions of the 101P3A11 gene, such as such regions containing one or more motifs. Exemplary assays include both RT-PCR assays as well as single-strand conformation polymorphism (SSCP) analysis (see, e.g., Marrogi et al., J. Cutan. Pathol. 26(8): 369–378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of 101P3A11. For example, antisense molecules can be RNAs or other molecules, including peptide nucleic acids (PNAs) or non-nucleic acid molecules such as phosphorothioate derivatives, that specifically bind DNA or RNA in a base pair-dependent manner. A skilled artisan can readily obtain these classes of nucleic acid molecules using the 101P3A11 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 101P3A11. See for example, Jack Cohen, Oligodeoxynucleotides, Antisense Inhibitors of Gene Expression, CRC Press, 1989; and Synthesis 1:1–5 (1988). The 101P3A11 antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See Iyer, R. P. et al, J. Org. Chem. 55:4693–4698 (1990); and Iyer, R. P. et al., J. Am. Chem. Soc. 112:1253–1254 (1990). Additional 101P3A11 antisense oligonucleotides of the present invention include morpholino antisense oligonucleotides known in the art (see, e.g., Partridge et al., 1996, Antisense & Nucleic Acid Drug Development 6: 169–175).

The 101P3A11 antisense oligonucleotides of the present invention typically can be RNA or DNA that is complementary to and stably hybridizes with the first 100 5' codons or last 100 3' codons of the 101P3A11 genomic sequence or the corresponding mRNA. Absolute complementarity is not required, although high degrees of complementarity are preferred. Use of an oligonucleotide complementary to this region allows for the selective hybridization to 101P3A11 mRNA and not to mRNA specifying other regulatory subunits of protein kinase. In one embodiment, 101P3A11 antisense oligonucleotides of the present invention are 15 to 30-mer fragments of the antisense DNA molecule that have a sequence that hybridizes to 101P3A11 mRNA. Optionally, 101P3A11 antisense oligonucleotide is a 30-mer oligonucleotide that is complementary to a region in the first 10 5' codons or last 10 3' codons of 101P3A11. Alternatively, the antisense molecules are modified to employ ribozymes in the inhibition of 101P3A11 expression, see, e.g., L. A. Couture & D. T. Stinchcomb; Trends Genet 12: 510–515 (1996).

II.A.3.) Primers and Primer Pairs

Further specific embodiments of this nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 101P3A11 polynucleotide in a sample and as a means for detecting a cell expressing a 101P3A11 protein.

Examples of such probes include polypeptides comprising all or part of the human 101P3A11 cDNA sequence shown in FIG. 2. Examples of primer pairs capable of specifically amplifying 101P3A11 mRNAs are also described in the Examples. As will be understood by the skilled artisan, a great many different primers and probes can be prepared based on the sequences provided herein and used effectively to amplify and/or detect a 101P3A11 mRNA.

The 101P3A11 polynucleotides of the invention are useful for a variety of purposes, including but not limited to their use as probes and primers for the amplification and/or detection of the 101P3A11 gene(s), mRNA(s), or fragments thereof; as reagents for the diagnosis and/or prognosis of prostate cancer and other cancers; as coding sequences capable of directing the expression of 101P3A11 polypeptides; as tools for modulating or inhibiting the expression of the 101P3A11 gene(s) and/or translation of the 101P3A11 transcript(s); and as therapeutic agents.

The present invention includes the use of any probe as described herein to identify and isolate a 101P3A11 or 101P3A11 related nucleic acid sequence from a naturally occurring source, such as humans or other mammals, as well as the isolated nucleic acid sequence per se, which would comprise all or most of the sequences found in the probe used.

II.A.4.) Isolation of 101P3A11-Encoding Nucleic Acid Molecules

The 101P3A11 cDNA sequences described herein enable the isolation of other polynucleotides encoding 101P3A11 gene product(s), as well as the isolation of polynucleotides encoding 101P3A11 gene product homologs, alternatively spliced isoforms, allelic variants, and mutant forms of the 101P3A11 gene product as well as polynucleotides that encode analogs of 101P3A11-related proteins. Various molecular cloning methods that can be employed to isolate full length cDNAs encoding an 101P3A11 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing 101P3A11 gene cDNAs can be identified by probing with a labeled 101P3A11 cDNA or a fragment thereof. For example, in one embodiment, the 101P3A11 cDNA (FIG. 2) or a portion thereof can be synthesized and used as a probe to retrieve overlapping and full-length cDNAs corresponding to a 101P3A11 gene. The 101P3A11 gene itself can be isolated by screening genomic DNA libraries, bacterial artificial chromosome libraries (BACs), yeast artificial chromosome libraries (YACs), and the like, with 101P3A11 DNA probes or primers.

II.A.5.) Recombinant Nucleic Acid Molecules and Host-Vector Systems

The invention also provides recombinant DNA or RNA molecules containing an 101P3A11 polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al, 1989, supra).

The invention further provides a host-vector system comprising a recombinant DNA molecule containing a 101P3A11 polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 101P3A11 or a fragment, analog or homolog thereof can be used to generate 101P3A11 proteins or fragments thereof using any number of host-vector systems routinely used and widely known in the art.

A wide range of host-vector systems suitable for the expression of 101P3A11 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11: 1785). Using these expression vectors, 101P3A11 can be expressed in several prostate cancer and non-prostate cell lines, including for example 293, 293T, rat-1, NIH 3T3 and TsuPr1. The host-vector systems of the invention are useful for the production of a 101P3A11 protein or fragment thereof. Such host-vector systems can be employed to study the functional properties of 101P3A11 and 101P3A11 mutations or analogs.

Recombinant human 101P3A11 protein or an analog or homolog or fragment thereof can be produced by mammalian cells transfected with a construct encoding a 101P3A11-related nucleotide. For example, 293T cells can be transfected with an expression plasmid encoding 101P3A11 or fragment, analog or homolog thereof, the 101P3A11 or related protein is expressed in the 293T cells, and the recombinant 101P3A11 protein is isolated using standard purification methods (e.g., affinity purification using anti-101P3A11 antibodies). In another embodiment, a 101P3A11 coding sequence is subcloned into the retroviral vector pSRαMSVtkneo and used to infect various mammalian cell lines, such as NIH 3T3, TsuPr1, 293 and rat-1 in order to establish 101P3A11 expressing cell lines. Various other expression systems well known in the art can also be employed. Expression constructs encoding a leader peptide joined in frame to the 101P3A11 coding sequence can be used for the generation of a secreted form of recombinant 101P3A11 protein.

As discussed herein, redundancy in the genetic code permits variation in 101P3A11 gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET such as at URL www.dna.affrc.go.jp/~nakamura/codon.html.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol. Cell Biol.,* 9:5073–5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662–2666, (1995) and Kozak NAR 15(20): 8125–8148 (1987)).

III.) 101P3A11-related Proteins

Another aspect of the present invention provides 101P3A11-related proteins. Specific embodiments of 101P3A11 proteins comprise a polypeptide having all or part of the amino acid sequence of human 101P3A11 as shown in FIG. 2 or FIG. 3. Alternatively, embodiments of 101P3A11 proteins comprise variant, homolog or analog polypeptides that have alterations in the amino acid sequence of 101P3A11 shown in FIG. 2 or FIG. 3.

In general, naturally occurring allelic variants of human 101P3A11 share a high degree of structural identity and homology (e.g., 90% or more homology). Typically, allelic variants of the 101P3A11 protein contain conservative amino acid substitutions within the 101P3A11 sequences described herein or contain a substitution of an amino acid from a corresponding position in a homologue of 101P3A11. One class of 101P3A11 allelic variants are proteins that share a high degree of homology with at least a small region of a particular 101P3A11 amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13–15 "Biochemistry" 2nd ED. Lubert Stryer ed (Stanford University); Henikoff et al., PNAS 1992 Vol 89 10915–10919; Lei et al., J Biol Chem 1995 May 19; 270(20):11882–6).

Embodiments of the invention disclosed herein include a wide variety of art-accepted variants or analogs of 101P3A11 proteins such as polypeptides having amino acid insertions, deletions and substitutions. 101P3A11 variants can be made using methods known in the art such as site-directed mutagenesis, alanine scanning, and PCR mutagenesis. Site-directed mutagenesis (Carter et al., *Nucl. Acids Res.*, 13:4331 (1986); Zoller et al., *Nucl. Acids Res.*, 10:6487 (1987)), cassette mutagenesis (Wells et al., Gene, 34:315 (1985)), restriction selection mutagenesis (Wells et al., *Philos. Trans. R. Soc. London SerA*, 317:415 (1986)) or other known techniques can be performed on the cloned DNA to produce the 101P3A11 variant DNA.

Scanning amino acid analysis can also be employed to identify one or more amino acids along a contiguous sequence that is involved in a specific biological activity such as a protein—protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W.H. Freeman & Co., N.Y.); Chothia, J. Mol. Biol., 150:1 (1976)). If alanine substitution does not yield adequate amounts of variant, an isosteric amino acid can be used.

As defined herein, 101P3A11 variants, analogs or homologs, have the distinguishing attribute of having at least one epitope that is "cross reactive" with a 101P3A11 protein having the amino acid sequence of SEQ ID NO: 703. As used in this sentence, "cross reactive" means that an antibody or T cell that specifically binds to an 101P3A11 variant also specifically binds to the 101P3A11 protein having the amino acid sequence of SEQ ID NO: 703. A polypeptide ceases to be a variant of the protein shown in SEQ ID NO: 703 when it no longer contains any epitope capable of being recognized by an antibody or T cell that specifically binds to the 101P3A11 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949–6955; Hebbes et al., Mol Immunol (1989) 26(9): 865–73; Schwartz et al., J Immunol (1985) 135(4):2598–608.

Another class of 101P3A11-related protein variants share 70%, 75%, 80%, 85% or 90% or more similarity with the amino acid sequence of SEQ ID NO: 703 or a fragment thereof. Another specific class of 101P3A11 protein variants or analogs comprise one or more of the 101P3A11 biological motifs described herein or presently known in the art. Thus, encompassed by the present invention are analogs of 101P3A11 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of the 101P3A11 protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of the 101P3A11 protein shown in FIG. 2 or FIG. 3. With respect to any aspect or embodiment of the invention, a peptide or peptides may be on one or more than one molecule and may include "pseudopeptides" made of amino acid-like residues that are linked by non-peptide bonds such as, but not limited to, —$CH_2$—NH—.

Moreover, representative embodiments of the invention disclosed herein include polypeptides consisting of about amino acid 1 to about amino acid 10 of the 101P3A11 protein shown in FIG. 2 or FIG. 3, polypeptides consisting of about amino acid 10 to about amino acid 20 of the 101P3A11 protein shown in FIG. 2 or FIG. 3, polypeptides consisting of about amino acid 20 to about amino acid 30 of the 101P3A11 protein shown in FIG. 2 or FIG. 3, polypeptides consisting of about amino acid 30 to about amino acid 40 of the 101P3A11 protein shown in FIG. 2 or FIG. 3, polypeptides consisting of about amino acid 40 to about amino acid 50 of the 101P3A11 protein shown in FIG. 2 or FIG. 3, polypeptides consisting of about amino acid 50 to about amino acid 60 of the 101P3A11 protein shown in FIG. 2 or FIG. 3, polypeptides consisting of about amino acid 60 to about amino acid 70 of the 101P3A11 protein shown in FIG. 2 or FIG. 3, polypeptides consisting of about amino acid 70 to about amino acid 80 of the 101P3A11 protein shown in FIG. 2 or FIG. 3, polypeptides consisting of about amino acid 80 to about amino acid 90 of the 101P3A11 protein shown in FIG. 2 or FIG. 3, polypeptides consisting of about amino acid 90 to about amino acid 100 of the 101P3A11 protein shown in FIG. 2 or FIG. 3, etc. throughout the entirety of the 101P3A11 amino acid sequence. Moreover, polypeptides consisting of about amino acid 1 (or 20 or 30 or 40 etc.) to about amino acid 20, (or 130, or 140 or 150 etc.) of the 101P3A11 protein shown in FIG. 2 or FIG. 3 are embodiments of the invention. It is to be appreciated that the starting and stopping positions in this paragraph refer to the specified position as well as that position plus or minus 5 residues.

101P3A11 related proteins are generated using standard peptide synthesis technology or using chemical cleavage methods well known in the art. Alternatively, recombinant methods can be used to generate nucleic acid molecules that encode a 101P3A11-related protein. In one embodiment, nucleic acid molecules provide a means to generate defined fragments of the 101P3A11 protein (or variants, homologs or analogs thereof).

III.A.) Motif-Bearing Protein Embodiments

Additional illustrative embodiments of the invention disclosed herein include 101P3A11 polypeptides comprising the amino acid residues of one or more of the biological motifs contained within the 101P3A11 polypeptide sequence set forth in FIG. 2 or FIG. 3. Various motifs are known in the art, and a protein can be evaluated for the presence of such motifs by a number of publicly available Internet sites (see, e.g., URL addresses: pfam.wustl.edu/; searchlauncher.bcm.tmc.edu/seq-search/struc-predict.html; psort.ims.u-tokyo.ac.jp/; www.cbs.dtu.dk; www.ebi.ac.uk/interpro/scan.html; www.expasy.ch/tools/scnpsitl.html; Epimatrix™ and Epimer™, Brown University, www.brown- .edu/Research/TB-HIV_Lab/epimatrix/epimatrix.html; and BIMAS, bimas.dcrt.nih.gov/.).

Motif bearing subsequences of the 101P3A11 protein are set forth and identified in Table XIX.

Table XX sets forth several frequently occurring motifs based on pfam searches (see URL address pfam.wustl.edu/). The columns of Table XX list (1) motif name abbreviation, (2) percent identity found amongst the different member of the motif family, (3) motif name or description and (4) most common function; location information is included if the motif is relevant for location.

Polypeptides comprising one or more of the 101P3A11 motifs discussed above are useful in elucidating the specific characteristics of a malignant phenotype in view of the observation that the 101P3A11 motifs discussed above are associated with growth dysregulation and because 101P3A11 is expressed or overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165–174 (1998); Gaiddon et al., Endocrinology 136(10): 4331–4338 (1995); Hall et al., Nucleic Acids Research 24(6): 1119–1126 (1996); Peterziel et al., Oncogene 18(46): 6322–6329 (1999) and O'Brian, Oncol. Rep. 5(2): 305–309 (1998)). Moreover, both glycosylation and myristoylation are protein modifications also associated with cancer and cancer progression (see e.g. Dennis et al., Biochem. Biophys. Acta 1473(1):21–34 (1999); Raju et al., Exp. Cell Res. 235(1): 145–154 (1997)). Amidation is another protein modification also associated with cancer and cancer progression (see e.g. Treston et al., J. Natl. Cancer Inst. Monogr. (13): 169–175 (1992)).

In another embodiment, proteins of the invention comprise one or more of the immunoreactive epitopes identified in accordance with art-accepted methods, such as the peptides set forth in Tables V–XVIII or XXVI–XXVIII. CTL epitopes can be determined using specific algorithms to identify peptides within an 101P3A11 protein that are capable of optimally binding to specified HLA alleles (e.g., Table IV; Epimatrix™ and Epimer™, Brown University, URL brown.edu/Research/TB-HIV-Lab/epimatrix/epimatrix.html; and BIMAS, URL bimas.dcrt.nih.gov/.) Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, one can substitute out a deleterious residue in favor of any other residue, such as a preferred residue as defined in Table IV; substitute a less-preferred residue with a preferred residue as defined in Table IV; or substitute an originally-occurring preferred residue with another preferred residue as defined in Table IV. Substitutions can occur at primary anchor positions or at other positions in a peptide; see, e.g., Table IV.

A variety of references reflect the art regarding the identification and generation of epitopes in a protein of interest as well as analogs thereof. See, for example, WO 9733602 to Chesnut et al.; Sette, Immunogenetics 1999 50(3–4): 201–212; Sette et al., J. Immunol. 2001 166(2): 1389–1397; Sidney et al., Hum. Immunol. 1997 58(1): 12–20; Kondo et al., Immunogenetics 1997 45(4): 249–258; Sidney et al., J. Immunol. 1996 157(8): 3480–90; and Falk et al., Nature 351: 290–6 (1991); Hunt et al., Science 255:1261–3 (1992); Parker et al., J. Immunol. 149:3580–7 (1992); Parker et al., J. Immunol. 152:163–75 (1994)); Kast et al., 1994 152(8): 3904–12; Borras-Cuesta et al., Hum. Immunol. 2000 61(3): 266–278; Alexander et al., J. Immunol. 2000 164(3); 164(3): 1625–1633; Alexander et al., PMID: 7895164, UI: 95202582; O'Sullivan et al., J. Immunol. 1991 147(8): 2663–2669; Alexander et al., Immunity 1994 1(9): 751–761 and Alexander et al., Immunol. Res. 1998 18(2): 79–92.

Related embodiments of the inventions include polypeptides comprising combinations of the different motifs set forth in Table XIX, and/or, one or more of the predicted CTL epitopes of Table V through Table XVIII, and/or, one or more of the T cell binding motifs known in the art. Preferred embodiments contain no insertions, deletions or substitutions either within the motifs or the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically the number of N-terminal and/or C-terminal amino acid residues on either side of a motif is between about 1 to about 100 amino acid residues, preferably 5 to about 50 amino acid residues.

101P3A11-related proteins are embodied in many forms, preferably in isolated form. A purified 101P3A11 protein molecule will be substantially free of other proteins or molecules that impair the binding of 101P3A11 to antibody, T cell or other ligand. The nature and degree of isolation and purification will depend on the intended use. Embodiments of a 101P3A11-related proteins include purified 101P3A11-related proteins and functional, soluble 101P3A11-related proteins. In one embodiment, a functional, soluble 101P3A11 protein or fragment thereof retains the ability to be bound by antibody, T cell or other ligand.

The invention also provides 101P3A11 proteins comprising biologically active fragments of the 101P3A11 amino acid sequence shown in FIG. 2 or FIG. 3. Such proteins exhibit properties of the 101P3A11 protein, such as the ability to elicit the generation of antibodies that specifically bind an epitope associated with the 101P3A11 protein; to be bound by such antibodies; to elicit the activation of HTL or CTL; and/or, to be recognized by HTL or CTL.

101P3A11-related polypeptides that contain particularly interesting structures can be predicted and/or identified using various analytical techniques well known in the art, including, for example, the methods of Chou-Fasman, Garnier-Robson, Eisenberg, Karplus-Schultz or Jameson-Wolf analysis, Hopp T. P. and Woods K. R., Kyte J. and Doolittle R. F., Janin J., Bhaskaran R., and Ponnuswamy P. K., Deleage, G. and Roux B., or on the basis of immunogenicity. Fragments that contain such structures are particularly useful in generating subunit-specific anti-101P3A11 antibodies, or T cells or in identifying cellular factors that bind to 101P3A11.

CTL epitopes can be determined using specific algorithms to identify peptides within an 101P3A11 protein that are capable of optimally binding to specified HLA alleles (e.g., by using the SYFPEITHI site at World Wide Web URL syfpeithi.bmi-heidelberg.com/; the listings in Table IV(A)–

(E); Epimatrix™ and Epimer™, Brown University, URL (www.brown.edu/Research/TB-HIV_Lab/epimatrix/epimatrix.html); and BIMAS, URL bimas.dcrt.nih.gov/). Illustrating this, peptide epitopes from 101P3A11 that are presented in the context of human MHC class I molecules HLA-A1, A2, A3, A11, A24, B7 and B35 were predicted (Tables V–XVIII). Specifically, the complete amino acid sequence of the 101P3A11 protein was entered into the HLA Peptide Motif Search algorithm found in the Bioinformatics and Molecular Analysis Section (BIMAS) web site listed above. The HLA peptide motif search algorithm was developed by Dr. Ken Parker based on binding of specific peptide sequences in the groove of HLA Class I molecules, in particular HLA-A2 (see, e.g., Falk et al., Nature 351: 290–6 (1991); Hunt et al., Science 255:1261–3 (1992); Parker et al., J. Immunol. 149:3580–7 (1992); Parker et al., J. Immunol. 152:163–75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for class I HLA-A2, the epitopes preferably contain a leucine (L) or methionine (M) at position 2 and a valine (V) or leucine (L) at the C-terminus (see, e.g., Parker et al., J. Immunol. 149:3580–7 (1992)). Selected results of 101P3A11 predicted binding peptides are shown in Tables V–XVIII or XXVI–XXVIII herein. In Tables V–XVIII, the top 50 ranking candidates, 9-mers and 10-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

In the BIMAS site, the algorithm used to score each 8-mer, 9-mer, or 10-mer peptide subsequence is as follows: The initial (running) score is set to 1.0. For each residue position, the program examines which amino acid appears at that position. The running score is then multiplied by the coefficient for that amino acid type, at that position, for the chosen HLA molecule. These coefficients were pre-calculated and were stored for use by the scoring algorithm in a separate directory as a collection of HLA coefficient files. Using 9-mers, nine multiplications are performed. Using 10-mers, nine multiplications are again performed, because the residue lying at the fifth position in the subsequence is skipped. The resulting running score is multiplied by a final constant to yield an estimate of the half time of disassociation. (This constant is stored at the end of the coefficient file for the HLA molecule. It can have a different value for each HLA molecule.) The final multiplication yields the score reported in the output table. Using 8-mers, eight multiplications are performed instead of nine, with a different coefficient matrix employed (20-by-8 rather than 20-by-9). For each HLA molecule evaluated by the BIMAS site, the coefficient values discussed above are stored in a file in a separate directory of coefficient files. When the user selects the HLA molecule type (or, on the restricted Web page for advanced users, selects the actual filename from the coefficient filename menu) and selects "9-mer" or "10-mer" as the length of the subsequence, the "standard" file containing the 20-by-9 coefficient matrix for the HLA molecule is read on-the-fly, with the 181 values (180 coefficient values plus one final constant) being read into an internal array for use by the scoring program. If the user selected "8-mer" as the subsequence length, then the program proceeds in the same fashion, but reads in a different coefficient file appropriate for 8-mer searches on that selected HLA molecule type.

In addition epitopes were identified from the SYFPEITHI site (SEQ ID NO: 2875) listed above. The scoring system for the SYFPEITHI site evaluates every amino acid within a given peptide. Individual amino acids may be given the arbitrary value 1 for amino acids that are only slightly preferred in the respective position, optimal anchor residues are given the value 15; any value between these two is possible. Negative values are also possible for amino acids which are disadvantageous for the peptide's binding capacity at a certain sequence position. The allocation of values is based on the frequency of the respective amino acid in natural ligands, T-cell epitopes, or binding peptides. Further explanations on the algorithm can be found in Rammensee, HG, et al. (1999) SYFPEITHI: database for MHC ligands and peptide motifs. Immunogenetics 50: 213–219. In order to have an extremely reliable SYFPEITHI epitope prediction algorithm, only those MHC class I alleles for which a large amount of data is available are included in the "epitope prediction" section of SYFPEITHI. A reliability of at least 80% in retrieving the most apt epitope can be expected. Thus the naturally presented epitope should be among the top-scoring 2% of all peptides predicted in 80% of all predictions. For example, if a protein sequence is as long as 400 amino acids, it can be split into 392 possible nonameric peptides. Therefore, the correct epitope should then be among the 8 top-scoring peptides. For epitope predictions using MHC class II motifs high reliabilities usually cannot be achieved because of the more variable pocket binding behavior. A reliability of approximately 50% only is expected for HLA class II epitopes.

Also, different MHC class I molecules prefer a different length of ligands. For example, SYFPEITHI offers predictions for H2-Kb octamers, HLA-A*0201 nonamers and decamers, or HLA-B8 octamers and nonamers. The maximal scores vary between different MHC alleles. Therefore, one can include known ligands/epitopes in order to have an approximation of the scoring. For example, the maximal score for HLA-A*0201 peptides is 36. The well-known epitope GILGFVFTL derived from the influenza A matrix protein scores 30. All predicted MHC class II ligands are 15mers, consisting of three N-terminal flanking residues, the nonamer core sequence located within the binding groove, and three C-terminal flanking residues. Thus, anchor residue PI appears in position 4 of the peptides predicted with "SYFPEITHI".

Accordingly, identification of HLA Class I and Class II immunogenic peptides for 101P3A11 was carried out using the SYFPEITHI database for MHC ligands and the accompanying prediction algorithm (Hans-Georg Rammensee, Jutta Bachmann, Niels Nikolaus Emmerich, Oskar Alexander Bachor, Stefan Stevanovic: SYFPEITHI: database for MHC ligands and peptide motifs. Immunogenetics 1999, 50: 213–219) accessed through the website with a URL: syfpeithi.bmi-heidelberg.com/scripts/MHCServer.dll/home-.htm. (Tables XXVI–XXVIII) For HLA Class I alleles nonameric (Table XXVI) and decameric peptides (Table XXVII) were identified. Given the nature of the HLA Class II binding pocket, for HLA Class II alleles sample 15-mer peptides were identified (Table XXVIII). It is appreciated by those in the art that additional amino acids can be present on the termini of the 15-mer epitopes, or that less than 15 amino acids can be present, and that the epitope will still be bound in the open-ended HLA Class II binding pocket.

For each given HLA allele, listed in Tables XXVI–XX-VIII are the peptides whose score ranks within the top 50% of the highest scoring peptide(s) predicted for that allele. For example, if the highest scoring value for nonamers of the HLA-A1 allele is 30, all peptides that are given a score of 15 or higher are listed. Listed in the tables is the amino acid position within the 101P3A11 protein sequence for the first amino acid of each listed peptide (Pos), the peptide sequence, and the relative ranked score (Score).

Actual binding of peptides to an HLA allele can be evaluated by stabilization of HLA expression on the antigen-processing defective cell line T2 (see, e.g., Xue et al., Prostate 30:73–8 (1997) and Peshwa et al., Prostate 36:129–38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV (or determined using World Wide Web site URL syfpeithi.bmi-heidelberg.com/) are to be "applied" to the 101P3A11 protein. As used in this context "applied" means that the 101P3A11 protein is evaluated, e.g., visually or by computer-based patterns finding methods, as appreciated by those of skill in the relevant art. Every subsequence of the 101P3A11 of 8, 9, 10, or 11 amino acid residues that bears an HLA Class I motif, or a subsequence of 9 or more amino acid residues that bear an HLA Class II motif are within the scope of the invention.

III.B.) Expression of 101P3A11-Related Proteins

In an embodiment described in the examples that follow, 101P3A11 can be conveniently expressed in cells (such as 293T cells) transfected with a commercially available expression vector such as a CMV-driven expression vector encoding 101P3A11 with a C-terminal 6×His and MYC tag (pcDNA3.1/mycHIS, Invitrogen or Tag5, GenHunter Corporation, Nashville Tenn.). The Tag5 vector provides an IgGK secretion signal that can be used to facilitate the production of a secreted 101P3A11 protein in transfected cells. The secreted HIS-tagged 101P3A11 in the culture media can be purified, e.g., using a nickel column using standard techniques.

III.C.) Modifications of 101P3A11-Related Proteins

Modifications of 101P3A11-related proteins such as covalent modifications are included within the scope of this invention. One type of covalent modification includes reacting targeted amino acid residues of a 101P3A11 polypeptide with an organic derivatizing agent that is capable of reacting with selected side chains or the N- or C-terminal residues of the 101P3A11. Another type of covalent modification of the 101P3A11 polypeptide included within the scope of this invention comprises altering the native glycosylation pattern of a protein of the invention. Another type of covalent modification of 101P3A11 comprises linking the 101P3A11 polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The 101P3A11-related proteins of the present invention can also be modified to form a chimeric molecule comprising 101P3A11 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of the 101P3A11 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 101P3A 11. A chimeric molecule can comprise a fusion of a 101P3A11-related protein with a poly-histidine epitope tag, which provides an epitope to which immobilized nickel can selectively bind, with cytokines or with growth factors. The epitope tag is generally placed at the amino- or carboxyl-terminus of the 101P3A11. In an alternative embodiment, the chimeric molecule can comprise a fusion of a 101P3A11-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 101P3A11 polypeptide in place of at least one variable region within an Ig molecule. In a preferred embodiment, the immunoglobulin fusion includes the hinge, CH2 and CH3, or the hinge, CH1, CH2 and CH3 regions of an IgGI molecule. For the production of immunoglobulin fusions see, e.g., U.S. Pat. No. 5,428,130 issued Jun. 27, 1995.

III.D.) Uses of 101P3A11-Related Proteins

The proteins of the invention have a number of different specific uses. As 101P3A11 is highly expressed in prostate and other cancers, 101P3A11-related proteins are used in methods that assess the status of 101P3A11 gene products in normal versus cancerous tissues, thereby elucidating the malignant phenotype. Typically, polypeptides from specific regions of the 101P3A11 protein are used to assess the presence of perturbations (such as deletions, insertions, point mutations etc.) in those regions (such as regions containing one or more motifs). Exemplary assays utilize antibodies or T cells targeting 101P3A11-related proteins comprising the amino acid residues of one or more of the biological motifs contained within the 101P3A11 polypeptide sequence in order to evaluate the characteristics of this region in normal versus cancerous tissues or to elicit an immune response to the epitope. Alternatively, 101P3A11-related proteins that contain the amino acid residues of one or more of the biological motifs in the 101P3A11 protein are used to screen for factors that interact with that region of 101P3A11.

101P3A11 protein fragments/subsequences are particularly useful in generating and characterizing domain-specific antibodies (e.g., antibodies recognizing an extracellular or intracellular epitope of an 101P3A11 protein), for identifying agents or cellular factors that bind to 101P3A11 or a particular structural domain thereof, and in various therapeutic and diagnostic contexts, including but not limited to diagnostic assays, cancer vaccines and methods of preparing such vaccines.

Proteins encoded by the 101P3A11 genes, or by analogs, homologs or fragments thereof, have a variety of uses, including but not limited to generating antibodies and in methods for identifying ligands and other agents and cellular constituents that bind to an 101P3A11 gene product. Antibodies raised against an 101P3A11 protein or fragment thereof are useful in diagnostic and prognostic assays, and imaging methodologies in the management of human cancers characterized by expression of 101P3A11 protein, such as those listed in Table 1. Such antibodies can be expressed intracellularly and used in methods of treating patients with such cancers. 101P3A11-related nucleic acids or proteins are also used in generating HTL or CTL responses.

Various immunological assays useful for the detection of 101P3A11 proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting 101P3A11-expressing cells (e.g., in radioscintigraphic imaging methods). 101P3A11 proteins are also particularly useful in generating cancer vaccines, as further described herein.

IV.) 101P3A11 Antibodies

Another aspect of the invention provides antibodies that bind to 101P3A11-related proteins. Preferred antibodies specifically bind to a 101P3A11-related protein and do not bind (or bind weakly) to peptides or proteins that are not 101P3A11-related proteins. For example, antibodies bind 101P3A11 can bind 101P3A11-related proteins such as the homologs or analogs thereof.

101P3A11 antibodies of the invention are particularly useful in cancer diagnostic, diagnostic and prognostic assays, and imaging methodologies. Similarly, such antibodies are useful in the treatment, diagnosis, and/or prognosis of other cancers, to the extent 101P3A11 is also expressed or overexpressed in these other cancers. Moreover, intracellularly expressed antibodies (e.g., single chain antibodies) are therapeutically useful in treating cancers in which the expression of 101P3A11 is involved, such as advanced or metastatic prostate cancers.

The invention also provides various immunological assays useful for the detection and quantification of 101P3A11 and mutant 101P3A11-related proteins. Such assays can comprise one or more 101P3A11 antibodies capable of recognizing and binding a 101P3A11-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 101P3A11 are also provided by the invention, including but not limited to radioscintigraphic imaging methods using labeled 101P3A11 antibodies. Such assays are clinically useful in the detection, monitoring, and prognosis of 101P3A11 expressing cancers such as prostate cancer.

101P3A11 antibodies are also used in methods for purifying a 101P3A11-related protein and for isolating 101P3A11 homologues and related molecules. For example, a method of purifying a 101P3A11-related protein comprises incubating an 101P3A11 antibody, which has been coupled to a solid matrix, with a lysate or other solution containing a 101P3A11-related protein under conditions that permit the 101P3A11 antibody to bind to the 101P3A11-related protein; washing the solid matrix to eliminate impurities; and eluting the 101P3A11-related protein from the coupled antibody. Other uses of the 101P3A11 antibodies of the invention include generating anti-idiotypic antibodies that mimic the 101P3A11 protein.

Various methods for the preparation of antibodies are well known in the art. For example, antibodies can be prepared by immunizing a suitable mammalian host using a 101P3A11-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of 110P3A11 can also be used, such as a 101P3A11 GST-fusion protein. In a particular embodiment, a GST fusion protein comprising all or most of the amino acid sequence of FIG. 2 or FIG. 3 is produced, then used as an immunogen to generate appropriate antibodies. In another embodiment, a 101P3A11-related protein is synthesized and used as an immunogen.

In addition, naked DNA immunization techniques known in the art are used (with or without purified 101P3A11-related protein or 101P3A11 expressing cells) to generate an immune response to the encoded immunogen (for review, see Donnelly et al., 1997, Ann. Rev. Immunol. 15: 617–648).

The amino acid sequence of 101P3A11 as shown in FIG. 2 or FIG. 3 can be analyzed to select specific regions of the 101P3A11 protein for generating antibodies. For example, hydrophobicity and hydrophilicity analyses of the 101P3A11 amino acid sequence are used to identify hydrophilic regions in the 101P3A11 structure. Regions of the 101P3A11 protein that show immunogenic structure, as well as other regions and domains, can readily be identified using various other methods known in the art, such as Chou-Fasman, Garnier-Robson, Eisenberg, Karplus-Schultz or Jameson-Wolf analysis, Hopp T. P. and Woods K. R., Kyte J. and Doolittle R. F., Janin J., Bhaskaran R., and Ponnuswamy P. K., or, Deleage, G. and Roux B. Thus, each region identified by any of these programs or methods is within the scope of the present invention. Methods for the generation of 101P3A11 antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 101P3A11 immunogen is often conducted by injection over a suitable time period and with use of a suitable adjuvant, as is understood in the art. During the immunization schedule, titers of antibodies can be taken to determine adequacy of antibody formation.

101P3A11 monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 101P3A11-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of the 101P3A11 protein can also be produced in the context of chimeric or complementarity determining region (CDR) grafted antibodies of multiple species origin. Humanized or human 101P3A11 antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522–525; Riechmann et al., 1988, Nature 332: 323–327; Verhoeyen et al., 1988, Science 239: 1534–1536). See also, Carter et al., 1993, Proc. Natl. Acad. Sci. USA 89:4285 and Sims et al., 1993, J. Immunol. 151: 2296.

Methods for producing fully human monoclonal antibodies include phage display and transgenic methods (for review, see Vaughan et al., 1998, Nature Biotechnology 16: 535–539). Fully human 101P3A11 monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45–64 (1993); Burton and Barbas, Human Antibodies from combinatorial libraries. Id., pp 65–82). Fully human 101P3A11 monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607–614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of 101P3A11 antibodies with an 101P3A11-related protein can be established by a number of well known means, including Western blot, immunoprecipitation, ELISA, and FACS analyses using, as appropriate, 101P3A11-related proteins, 101P3A11-expressing cells or extracts thereof A 101P3A11 antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 101P3A11 epitopes are generated using methods generally known in the art. Homodimeric antibodies can also be generated by cross-linking techniques known in the art (e.g., Wolff et al., Cancer Res. 53: 2560–2565).

V.) 101P3A11 Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., Cell 47:1071, 1986; Babbitt, B. P. et al., Nature 317:359, 1985; Townsend, A. and Bodmer, H., Annu. Rev. Immunol. 7:601, 1989; Germain, R. N., Annu. Rev. Immunol. 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., J. Immunol. 160:3363, 1998; Rammensee, et al., Immunogenetics 41:178, 1995; Rammensee et al., SYFPEITHI, access via World Wide Web at URL syfpeithi.bmi-heidelberg.com/; Sette, A. and Sidney, J. Curr. Opin. Immunol. 10:478, 1998; Engelhard, V. H., Curr. Opin. Immunol. 6:13, 1994; Sette, A. and Grey, H. M., Curr. Opin. Immunol. 4:79, 1992; Sinigaglia, F. and Hammer, J. Curr. Biol. 6:52, 1994; Ruppert et al., Cell 74:929–937, 1993; Kondo et al., J. Immunol. 155:4307–4312, 1995; Sidney et al., J. Immunol. 157:3480–3490, 1996; Sidney et al., Human Immunol. 45:79–93, 1996; Sette, A. and Sidney, J. Immunogenetics 1999 November; 50(3–4):201–12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. Annu. Rev. Immunol. 13:587, 1995; Smith, et al., Immunity 4:203, 1996; Fremont et al., Immunity 8:305, 1998; Stern et al., Structure 2:245, 1994; Jones, E. Y. Curr. Opin. Immunol. 9:75, 1997; Brown, J. H. et al., Nature 364:33, 1993; Guo, H. C. et al., Proc. Natl. Acad. Sci. USA 90:8053, 1993; Guo, H. C. et al., Nature 360:364, 1992; Silver, M. L. et al., Nature 360:367, 1992; Matsumura, M. et al., Science 257:927, 1992; Madden et al., Cell 70:1035, 1992; Fremont, D. H. et al., Science 257:919, 1992; Saper, M. A., Bjorkman, P. J. and Wiley, D.C., J. Mol. Biol. 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., Mol. Immunol. 32:603, 1995; Celis, E. et al., Proc. Natl. Acad. Sci. USA 91:2105, 1994; Tsai, V. et al., J. Immunol. 158:1796, 1997; Kawashima, I. et al., Human Immunol. 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., J. Immunol. 26:97, 1996; Wentworth, P. A. et al., Int. Immunol. 8:651, 1996; Alexander, J. et al., J. Immunol. 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1–2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) 101P3A11 Transgenic Animals

Nucleic acids that encode a 101P3A11-related protein can also be used to generate either transgenic animals or "knock out" animals which, in turn, are useful in the development and screening of therapeutically useful reagents. In accordance with established techniques, cDNA encoding 101P3A11 can be used to clone genomic DNA that encodes 101P3A11. The cloned genomic sequences can then be used to generate transgenic animals containing cells that express DNA that encode 101P3A11. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for 101P3A11 transgene incorporation with tissue-specific enhancers.

Transgenic animals that include a copy of a transgene encoding 101P3A11 can be used to examine the effect of increased expression of DNA that encodes 101P3A11. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 101P3A11 can be used to construct a 101P3A11 "knock out" animal that has a defective or altered gene encoding 101P3A11 as a result of homologous recombination between the endogenous gene encoding 101P3A11 and altered genomic DNA encoding 101P3A11 introduced into an embryonic cell of the animal. For example, cDNA that encodes 101P3A11 can be used to clone genomic DNA encoding 101P3A11 in accordance with established techniques. A portion of the genomic DNA encoding 101P3A11 can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell* 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell*, 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Practical Approach*, E. J. Robertson, ed. (IRL, Oxford, 1987), pp. 113–152). A chimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of the 101P3A11 polypeptide.

VII.) Methods for the Detection of 101P3A11

Another aspect of the present invention relates to methods for detecting 101P3A11 polynucleotides and 101P3A11-related proteins, as well as methods for identifying a cell that expresses 101P3A11. The expression profile of 101P3A 11 makes it a diagnostic marker for metastasized disease. Accordingly, the status of 101P3A11 gene products provides information useful for predicting a variety of factors including susceptibility to advanced stage disease, rate of progression, and/or tumor aggressiveness. As discussed in detail herein, the status of 101P3A11 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 101P3A11 polynucleotides in a biological sample, such as serum, bone, prostate, and other tissues, urine, semen, cell preparations, and the like. Detectable 101P3A11 polynucleotides include, for example, a 101P3A11 gene or fragment thereof, 101P3A11 mRNA, alternative splice variant 101P3A11 mRNAs, and recombinant DNA or RNA molecules that contain a 101P3A11 polynucleotide. A number of methods for amplifying and/or detecting the presence of 101P3A11 polynucleotides are well known in the art and can be employed in the practice of this aspect of the invention.

In one embodiment, a method for detecting an 101P3A11 mRNA in a biological sample comprises producing cDNA from the sample by reverse transcription using at least one primer; amplifying the cDNA so produced using an 101P3A11 polynucleotides as sense and antisense primers to amplify 101P3A11 cDNAs therein; and detecting the presence of the amplified 101P3A11 cDNA. Optionally, the sequence of the amplified 101P3A11 cDNA can be determined.

In another embodiment, a method of detecting a 101P3A11 gene in a biological sample comprises first isolating genomic DNA from the sample; amplifying the isolated genomic DNA using 101P3A11 polynucleotides as sense and antisense primers; and detecting the presence of the amplified 101P3A11 gene. Any number of appropriate sense and antisense probe combinations can be designed from the nucleotide sequence provided for the 101P3A11 (FIG. 2) and used for this purpose.

The invention also provides assays for detecting the presence of an 101P3A11 protein in a tissue or other biological sample such as serum, semen, bone, prostate, urine, cell preparations, and the like. Methods for detecting a 101P3A11-related protein are also well known and include, for example, immunoprecipitation, immunohistochemical analysis, Western blot analysis, molecular binding assays, ELISA, ELIFA and the like. For example, a method of detecting the presence of a 101P3A11-related protein in a biological sample comprises first contacting the sample with a 101P3A11 antibody, a 101P3A11-reactive fragment thereof, or a recombinant protein containing an antigen binding region of a 101P3A11 antibody; and then detecting the binding of 101P3A11-related protein in the sample.

Methods for identifying a cell that expresses 101P3A11 are also within the scope of the invention. In one embodiment, an assay for identifying a cell that expresses a 101P3A11 gene comprises detecting the presence of 101P3A11 mRNA in the cell. Methods for the detection of particular mRNAs in cells are well known and include, for example, hybridization assays using complementary DNA probes (such as in situ hybridization using labeled 101P3A11 riboprobes, Northern blot and related techniques) and various nucleic acid amplification assays (such as RT-PCR using complementary primers specific for 101P3A11, and other amplification type detection methods, such as, for example, branched DNA, SISBA, TMA and the like). Alternatively, an assay for identifying a cell that expresses a 101P3A11 gene comprises detecting the presence of 101P3A11-related protein in the cell or secreted by the cell. Various methods for the detection of proteins are well known in the art and are employed for the detection of 101P3A11-related proteins and cells that express 101P3A11-related proteins.

101P3A11 expression analysis is also useful as a tool for identifying and evaluating agents that modulate 101P3A11 gene expression. For example, 101P3A11 expression is significantly upregulated in prostate cancer, and is expressed in cancers of the tissues listed in Table I. Identification of a molecule or biological agent that inhibits 101P3A11 expression or over-expression in cancer cells is of therapeutic value. For example, such an agent can be identified by using a screen that quantifies 101P3A11 expression by RT-PCR, nucleic acid hybridization or antibody binding.

VIII.) Methods for Monitoring the Status of 101P3A11-related Genes and Their Products Oncogenesis is known to be a multistep process where cellular growth becomes progressively dysregulated and cells progress from a normal physiological state to precancerous and then cancerous states (see, e.g., Alers et al., Lab Invest. 77(5): 437–438 (1997) and Isaacs et al., Cancer Surv. 23: 19–32 (1995)). In this context, examining a biological sample for evidence of dysregulated cell growth (such as aberrant 101P3A11 expression in cancers) allows for early detection of such aberrant physiology, before a pathologic state such as cancer has progressed to a stage that therapeutic options are more limited and or the prognosis is worse. In such examinations, the status of 101P3A11 in a biological sample of interest can be compared, for example, to the status of 101P3A11 in a corresponding normal sample (e.g. a sample from that individual or alternatively another individual that is not affected by a pathology). An alteration in the status of b 101P3A11 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9;376 (2):306–14 and U.S. Pat. No. 5,837,501) to compare 101P3A11 status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 101P3A11 expressing cells) as well as the level, and biological activity of expressed gene products (such as 101P3A 11 mRNA, polynucleotides and polypeptides). Typically, an alteration in the status of 101P3A11 comprises a change in the location of 101P3A11 and/or 101P3A11 expressing cells and/or an increase in 101P3A11 mRNA and/or protein expression.

101P3A11 status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of the 101P3A11 gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 101P3A11 in a biological sample is evaluated by various methods utilized by skilled artisans including, but not limited to genomic Southern analysis (to examine, for example perturbations in the P3A11 gene), Northern analysis and/or PCR analysis of 101P3A11 mRNA (to examine, for example alterations in the polynucleotide sequences or expression levels of 101P3A 11 mRNAs), and, Western and/or immunohistochemical analysis (to examine, for example alterations in polypeptide sequences, alterations in polypeptide localization within a sample, alterations in expression levels of 101P3A11 proteins and/or associations of 101P3A11 proteins with polypeptide binding partners). Detectable 101P3A11 polynucleotides include, for example, a 101P3A11 gene or fragment thereof, 101P3A11 mRNA, alternative splice variants, 101P3A11 mRNAs, and recombinant DNA or RNA molecules containing a 101P3A11 polynucleotide.

The expression profile of 101P3A11 makes it a diagnostic marker for local and/or metastasized disease, and provides information on the growth or oncogenic potential of a biological sample. In particular, the status of 101P3A11 provides information useful for predicting susceptibility to particular disease stages, progression, and/or tumor aggressiveness. The invention provides methods and assays for determining 101P3A11 status and diagnosing cancers that express 101P3A11, such as cancers of the tissues listed in Table I. For example, because 101P3A11 mRNA is so highly expressed in prostate and other cancers relative to normal prostate tissue, assays that evaluate the levels of 101P3A11 mRNA transcripts or proteins in a biological sample can be used to diagnose a disease associated with 101P3A11 dysregulation, and can provide prognostic information useful in defining appropriate therapeutic options.

The expression status of 101P3A11 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 101P3A11 in biological samples such as those from individuals suffering from, or suspected of suffering from a pathology characterized by dysregulated cellular growth, such as cancer.

As described above, the status of 101P3A11 in a biological sample can be examined by a number of well-known procedures in the art. For example, the status of 101P3A11 in a biological sample taken from a specific location in the body can be examined by evaluating the sample for the presence or absence of 101P3A11 expressing cells (e.g. those that express 101P3A11 mRNAs or proteins). This examination can provide evidence of dysregulated cellular growth, for example, when 101P3A11-expressing cells are found in a biological sample that does not normally contain such cells (such as a lymph node), because such alterations in the status of 101P3A11 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315–317 (2000); Su et al., Semin. Surg. Oncol. 18(1): 17–28 (2000) and Freeman et al., J Urol 1995 August 154(2 Pt 1):474–8).

In one aspect, the invention provides methods for monitoring 101P3A11 gene products by determining the status of 101P3A11 gene products expressed by cells from an individual suspected of having a disease associated with dysregulated cell growth (such as hyperplasia or cancer) and then comparing the status so determined to the status of 101P3A11 gene products in a corresponding normal sample. The presence of aberrant 101P3A11 gene products in the test sample relative to the normal sample provides an indication of the presence of dysregulated cell growth within the cells of the individual.

In another aspect, the invention provides assays useful in determining the presence of cancer in an individual, comprising detecting a significant increase in 101P3A11 mRNA or protein expression in a test cell or tissue sample relative to expression levels in the corresponding normal cell or tissue. The presence of 101P3A11 mRNA can, for example, be evaluated in tissue samples including but not limited to those listed in Table I. The presence of significant 101P3A11 expression in any of these tissues is useful to indicate the emergence, presence and/or severity of a cancer, since the corresponding normal tissues do not express 101P3A11 mRNA or express it at lower levels.

In a related embodiment, 101P3A11 status is determined at the protein level rather than at the nucleic acid level. For example, such a method comprises determining the level of 101P3A11 protein expressed by cells in a test tissue sample and comparing the level so determined to the level of 101P3A11 expressed in a corresponding normal sample. In one embodiment, the presence of 101P3A 11 protein is evaluated, for example, using immunohistochemical methods. 101P3A11 antibodies or binding partners capable of detecting 101P3A11 protein expression are used in a variety of assay formats well known in the art for this purpose.

In a further embodiment, one can evaluate the status of 101P3A11 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369–378). For example, a mutation in the sequence of 101P3A11 may be indicative of the presence or promotion of a tumor. Such assays therefore have diagnostic and predictive value where a mutation in 101P3A11 indicates a potential loss of function or increase in tumor growth.

A wide variety of assays for observing perturbations in nucleotide and amino acid sequences are well known in the art. For example, the size and structure of nucleic acid or amino acid sequences of 101P3A11 gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of the 101P3A11 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985–1992 (1999)). In addition, this alteration is present in at least 70% of cases of high-grade prostatic intraepithelial neoplasia (PIN) (Brooks et al, Cancer Epidemiol. Biomarkers Prev., 1998, 7:531–536). In another example, expression of the LAGE-I tumor specific gene (which is not expressed in normal prostate but is expressed in 25–50% of prostate cancers) is induced by deoxy-azacytidine in lymphoblastoid cells, suggesting that tumoral expression is due to demethylation (Lethe et al., Int. J. Cancer 76(6): 903–908 (1998)). A variety of assays for examining methylation status of a gene are well known in the art. For example, one can utilize, in Southern hybridization approaches, methylation-sensitive restriction enzymes which cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al. eds., 1995.

Gene amplification is an additional method for assessing the status of 101P3A11. Gene amplification is measured in a sample directly, for example, by conventional Southern blotting or Northern blotting to quantitate the transcription of mRNA (Thomas, 1980, Proc. Natl. Acad. Sci. USA, 77:5201–5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 101P3A11 expression. The presence of RT-PCR amplifiable 101P3A11 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373–384; Ghossein et al., 1995, J. Clin. Oncol. 13:1195–2000; Heston et al., 1995, Clin. Chem. 41:1687–1688).

A further aspect of the invention is an assessment of the susceptibility that an individual has for developing cancer. In one embodiment, a method for predicting susceptibility to cancer comprises detecting 101P3A11 mRNA or 101P3A11 protein in a tissue sample, its presence indicating susceptibility to cancer, wherein the degree of 101P3A11 mRNA expression correlates to the degree of susceptibility. In a specific embodiment, the presence of 101P3A11 in prostate or other tissue is examined, with the presence of 101P3A11 in the sample providing an indication of prostate cancer susceptibility (or the emergence or existence of a prostate tumor). Similarly, one can evaluate the integrity 101P3A11 nucleotide and amino acid sequences in a biological sample, in order to identify perturbations in the structure of these molecules such as insertions, deletions, substitutions and the like. The presence of one or more perturbations in 101P3A11 gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 101P3A11 mRNA or 101P3A11 protein expressed by tumor cells, comparing the level so determined to the level of 101P3A11 mRNA or 101P3A11 protein expressed in a corresponding normal tissue taken from the same individual or a normal tissue reference sample, wherein the degree of 101P3A11 mRNA or 101P3A11 protein expression in the tumor sample relative to the normal sample indicates the degree of aggressiveness. In a specific embodiment, aggressiveness of a tumor is evaluated by determining the extent to which 101P3A11 is expressed in the tumor cells, with higher expression levels indicating more aggressive tumors. Another embodiment is the evaluation of the integrity of 101P3A11 nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 101P3A11 mRNA or 101P3A11 protein expressed by cells in a sample of the tumor, comparing the level so determined to the level of 101P3A11 mRNA or 101P3A11 protein expressed in an equivalent tissue sample taken from the same individual at a different time, wherein the degree of 101P3A11 RNA or 101P3A11 protein expression in the tumor sample over time provides information on the progression of the cancer. In a specific embodiment, the progression of a cancer is evaluated by determining 101P3A11 expression in the tumor cells over time, where increased expression over time indicates a progression of the cancer. Also, one can evaluate the integrity 101P3A11 nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 101P3A11 gene and 101P3A11 gene products (or perturbations in 101P3A11 gene and 101P3A11 gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74–88; Epstein, 1995, Hum. Pathol. 26(2):223–9; Thorson et al., 1998, Mod. Pathol. 11(6):543–51; Baisden et al., 1999, Am. J. Surg. Pathol. 23(8):918–24). Methods for observing a coincidence between the expression of 101P3A11 gene and 101P3A11 gene products (or perturbations in 101P3A11 gene and 101P3A11 gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of 101P3A11 gene and 101P3A11 gene products (or perturbations in 101P3A11 gene and 101P3A11 gene products) and another factor associated with malignancy entails detecting the overexpression of 101P3A11 mRNA or protein in a tissue sample, detecting the overexpression of PSA mRNA or protein in a tissue sample (or PSCA or PSM expression), and observing a coincidence of 101P3A11 mRNA or protein and PSA mRNA or protein overexpression (or PSCA or PSM expression). In a specific embodiment, the expression of 101P3A11 and PSA mRNA in prostate tissue is examined, where the coincidence of 101P3A11 and PSA mRNA overexpression in the sample indicates the existence of prostate cancer, prostate cancer susceptibility or the emergence or status of a prostate tumor.

Methods for detecting and quantifying the expression of 101P3A11 mRNA or protein are described herein, and standard nucleic acid and protein detection and quantification technologies are well known in the art. Standard methods for the detection and quantification of 101P3A11 mRNA include in situ hybridization using labeled 101P3A11 riboprobes, Northern blot and related techniques using 101P3A11 polynucleotide probes, RT-PCR analysis using primers specific for 101P3A11, and other amplification type detection methods, such as, for example, branched DNA, SISBA, TMA and the like. In a specific embodiment, semi-quantitative RT-PCR is used to detect and quantify 101P3A11 mRNA expression. Any number of primers capable of amplifying 101P3A11 can be used for this purpose, including but not limited to the various primer sets specifically described herein. In a specific embodiment, polyclonal or monoclonal antibodies specifically reactive with the wild-type 101P3A11 protein can be used in an immunohistochemical assay of biopsied tissue.

IX.) Identification of Molecules that Interact with 101P3A11

The 101P3A11 protein and nucleic acid sequences disclosed herein allow a skilled artisan to identify proteins, small molecules and other agents that interact with 101P3A11, as well as pathways activated by 101P3A11 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein—protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83–86).

Alternatively one can screen peptide libraries to identify molecules that interact with 101P3A11 protein sequences. In such methods, peptides that bind to 101P3A11 are identified by screening libraries that encode a random or controlled collection of amino acids. Peptides encoded by the libraries are expressed as fusion proteins of bacteriophage coat proteins, the bacteriophage particles are then screened against the 101P3A11 protein.

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 101P3A11 protein sequences are disclosed for example in U.S. Pat. No. 5,723,286 issued 3 Mar. 1998 and U.S. Pat. No. 5,733,731 issued 31 Mar. 1998.

Alternatively, cell lines that express 101P3A11 are used to identify protein—protein interactions mediated by 101P3A11. Such interactions can be examined using immunoprecipation techniques (see, e.g., Hamilton B. J., et al. Biochem. Biophys. Res. Commun. 1999, 261:646–51). 101P3A11 protein can be immunoprecipitated from 101P3A11-expressing cell lines using anti-101P3A11 antibodies. Alternatively, antibodies against His-tag can be used in a cell line engineered to express fusions of 101P3A11 and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with 101P3A11 can be identified through related embodiments of such screening assays. For example, small molecules can be identified that interfere with protein function, including molecules that interfere with 101P3A11 ability to mediate phosphorylation and de-phosphorylation, interaction with DNA or RNA molecules as an indication of regulation of cell cycles, second messenger signaling or tumorigenesis. Similarly, small molecules that modulate 101P3A11-related ion channel, protein pump, or cell communication functions are identified and used to treat patients that have a cancer that expresses 101P3A11 (see, e.g., Hille, B., Ionic Channels of Excitable Membranes $2^{nd}$ Ed., Sinauer Assoc., Sunderland, Mass., 1992). Moreover, ligands that regulate 101P3A11 function can be identified based on their ability to bind 101P3A11 and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 101P3A11 and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators which activate or inhibit An embodiment of this invention comprises a method of screening for a molecule that interacts with an 101P3A11 amino acid sequence shown in FIG. 2 or FIG. 3, comprising the steps of contacting a population of molecules with the 101P3A11 amino acid sequence, allowing the population of molecules and the 101P3A11 amino acid sequence to interact under conditions that facilitate an interaction, determining the presence of a molecule that interacts with the 101P3A11 amino acid sequence, and then separating molecules that do not interact with the 101P3A11 amino acid sequence from molecules that do. In a specific embodiment, the method further comprises purifying, characterizing and identifying a molecule that interacts with the 101P3A11 amino acid sequence. The identified molecule can be used to modulate a function performed by 101P3A11. In a preferred embodiment, the 101P3A11 amino acid sequence is contacted with a library of peptides.

Non-limiting examples of small molecules include compounds that bind members of the olfactory receptor family of GPCR., ligands including hormones, neuropeptides, chemokines, odorants, phospholipids, and functional equivalents thereof that bind and preferably inhibit 101P3A11 protein function. Such non-limiting small molecules preferably have a molecular weight of less than about 10 kDa, more preferably below about 9, about 8, about 7, about 6, about 5 or about 4 kDa; physically associates with, or binds, 101P3A11 protein; is not found in naturally occurring metabolic pathways; and/or are more soluble in aqueous than non-aqueous solutions.

X.) Therapeutic Methods and Compositions

The identification of 101P3A11 as a protein that is normally expressed in a restricted set of tissues, but which is also expressed in prostate and other cancers, opens a number of therapeutic approaches to the treatment of such cancers. As contemplated herein, 101P3A11 functions as a transcription factor involved in activating tumor-promoting genes or repressing genes that block tumorigenesis.

Accordingly, therapeutic approaches that inhibit the activity of the 101P3A11 protein are useful for patients suffering from a cancer that expresses 101P3A11. These therapeutic approaches generally fall into two classes. One class comprises various methods for inhibiting the binding or association of the 101P3A11 protein with its binding partner or with other proteins. Another class comprises a variety of methods for inhibiting the transcription of the 101P3A11 gene or translation of 101P3A11 mRNA.

X.A.) Anti-Cancer Vaccines

The invention provides cancer vaccines comprising a 101P3A11-related protein or 101P3A11-related nucleic acid. In view of the expression of 101P3A11, cancer vaccines prevent and/or treat 101P3A11-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231–237; Fong et al., 1997, J. Immunol. 159:3113–3117).

Such methods can be readily practiced by employing a 101P3A11-related protein, or an 101P3A11-encoding nucleic acid molecule and recombinant vectors capable of expressing and presenting the 101P3A11 immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 Feb. 31(1):66–78; Maruyama et al., Cancer Immunol Immunother 2000 June 49(3):123–32) Briefly, such methods of generating an immune response (e.g. humoral and/or cell-mediated) in a mammal, comprise the steps of: exposing the mammal's immune system to an immunoreactive epitope (e.g. an epitope present in the 101P3A11 protein shown in SEQ ID NO: 703 or analog or homolog thereof) so that the mammal generates an immune response that is specific for that epitope (e.g. generates antibodies that specifically recognize that epitope). In a preferred method, the 101P3A11 immunogen contains a biological motif, see e.g., Tables V–XVIII or XXVI–XXVIII, or a peptide of a size range from 101P3A11 indicated in FIG. 5, FIG. 6, FIG. 7, FIG. 8, and FIG. 9.

The entire 101P3A11 protein, immunogenic regions or epitopes thereof can be combined and delivered by various means. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287–294, 1991: Alonso et al., *Vaccine* 12:299–306, 1994; Jones et al., *Vaccine* 13:675–681, 1995), peptide compositions contained in immune stimulating complexes (ISCOMS) (see, e.g., Takahashi et al., *Nature* 344:873–875, 1990; Hu et al., *Clin Exp Immunol.* 113:235–243, 1998), multiple antigen peptide systems (MAPs) (see e.g., Tam, *J. P., Proc. Natl. Acad. Sci. U.S.A.* 85:5409–5413, 1988; Tam, J. P., *J. Immunol. Methods* 196:17–32, 1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990), particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med.* 7:649, 1995), adjuvants (Warren, H. S., Vogel, F. R., and Chedid, L. A. *Annu. Rev. Immunol.* 4:369, 1986; Gupta, R. K. et al., *Vaccine* 11:293, 1993), liposomes (Reddy, R. et al., *J. Immunol.* 148:1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A., *Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

In patients with 101P3A11-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within 101P3A11 protein that bind corresponding HLA alleles (see e.g., Table IV; Epimer™ and Epimatrix™, Brown University (URL www.brown.edu/Research/TB-HIV_Lab/epimatrix/epimatrix.html); and, BIMAS, (URL bimas.dcrt.nih.gov/; SYFPEITHI at URL syfpeithi.bmi-heidelberg.com/). In a preferred embodiment, the 101P3A11 immunogen contains one or more amino acid sequences identified using techniques well known in the art, such as the sequences shown in Tables V–XVIII or XXVI–XXVIII or a peptide of 8, 9, 10 or 11 amino acids specified by an HLA Class I motif/supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-Based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. the 101P3A11 protein) so that an immune response is generated. In one embodiment the protein can be an anti idiotypic antibody. A typical embodiment consists of a method for generating an immune response to 101P3A11 in a host, by contacting the host with a sufficient amount of at least one 101P3A11 B cell or cytotoxic T-cell epitope or analog thereof; and at least one periodic interval thereafter re-contacting the host with the 101P3A11 B cell or cytotoxic T-cell epitope or analog thereof. A specific embodiment consists of a method of generating an immune response against a 101P3A11-related protein or a man-made multiepitopic peptide comprising: administering 101P3A11 immunogen (e.g. the 101P3A11 protein or a peptide fragment thereof, an 101P3A11 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625–1633; Alexander et al., Immunity 1994 1(9): 751–761 and Alexander et al., Immunol. Res. 1998 18(2): 79–92). An alternative method comprises generating an immune response in an individual against a 101P3A11 immunogen by: administering in vivo to muscle or skin of the individual's body a DNA molecule that comprises a DNA sequence that encodes an 101P3A11 immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered.

Nucleic Acid Vaccines:

Vaccine compositions of the invention include nucleic acid-mediated modalities. DNA or RNA that encode protein(s) of the invention can be administered to a patient. Genetic immunization methods can be employed to generate prophylactic or therapeutic humoral and cellular immune responses directed against cancer cells expressing 101P3A11. Constructs comprising DNA encoding a 101P3A11-related protein/immunogen and appropriate regulatory sequences can be injected directly into muscle or skin of an individual, such that the cells of the muscle or skin take-up the construct and express the encoded 101P3A11 protein/immunogen. Alternatively, a vaccine comprises a 101P3A11-related protein. Expression of the 101P3A11-related protein immunogen results in the generation of prophylactic or therapeutic humoral and cellular immunity against cells that bear 101P3A11 protein. Various prophylactic and therapeutic genetic immunization techniques known in the art can be used (for review, see information and references published at Internet address www.genweb.com). Nucleic acid-based delivery is described, for instance, in Wolff et. al., *Science* 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658–663; Tsang et al. *J. Natl. Cancer Inst.* 87:982–990 (1995)). Non-viral delivery systems can also be employed by introducing naked DNA encoding a 101P3A11-related protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456–460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Thus, gene delivery systems are used to deliver a 101P3A11-related nucleic acid molecule. In one embodiment, the full-length human 101P3A11 cDNA is employed. In another embodiment, 101P3A11 nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendritic cells (DC) to present 101P3A11 antigen to a patient's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65–69; Murphy et al., 1996, Prostate 29:371–380). Thus, dendritic cells can be used to present 101P3A11 peptides to T cells in the context of MHC class I or II molecules. In one embodiment, autologous dendritic cells are pulsed with 101P3A11 peptides capable of binding to MHC class I and/or class II molecules. In another embodiment, dendritic cells are pulsed with the complete 101P3A11 protein. Yet another embodiment involves engineering the overexpression of the 101P3A11 gene in dendritic cells using various implementing vectors known in the art, such as adenovirus (Arthur et al., 1997, Cancer Gene Ther. 4:17–25), retrovirus (Henderson et al., 1996, Cancer Res. 56:3763–3770), lentivirus, adeno-associated virus, DNA transfection (Ribas et al., 1997, Cancer Res. 57:2865–2869), or tumor-derived RNA transfection (Ashley et al., 1997, J. Exp. Med. 186:1177–1182). Cells that express 101P3A11 can also be engineered to express immune modulators, such as GM-CSF, and used as immunizing agents.

X.B.) 101P3A11 as a Target for Antibody-Based Therapy

101P3A11 is an attractive target for antibody-based therapeutic strategies. A number of antibody strategies are known in the art for targeting both extracellular and intracellular molecules (e.g., complement and ADCC mediated killing, the use of intrabodies, and conjugated antibodies) 101P3A11 is expressed by cancer cells of various lineages relative to corresponding normal cells, systemic administration of 101P3A11-immunoreactive compositions are prepared that exhibit excellent sensitivity without toxic, non-specific and/or non-target effects caused by binding of the immunoreactive composition to non-target organs and tissues. Antibodies specifically reactive with domains of 101P3A11 are useful to treat 101P3A11-expressing cancers systemically, either as conjugates with a toxin or therapeutic agent, or as naked antibodies capable of inhibiting cell proliferation or function.

101P3A11 antibodies can be introduced into a patient such that the antibody binds to 101P3A11 and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 101P3A11, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of the 101P3A11 sequence shown in FIG. 2 or FIG. 3. In addition, skilled artisans understand that it is routine to conjugate antibodies to cytotoxic agents (see, e.g., Slevers et al. *Blood* 93:11 3678–3684 (Jun. 1, 1999)). When cytotoxic and/or therapeutic agents are delivered directly to cells, such as by conjugating them to antibodies specific for a molecule expressed by that cell (e.g. 101P3A11), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-101P3A11 antibody) that binds to a marker (e.g. 101P3A11) expressed, accessible to binding or localized on the cell surfaces. A typical embodiment is a method of delivering a cytotoxic and/or therapeutic agent to a cell expressing 101P3A11, comprising conjugating the cytotoxic agent to an antibody that immunospecifically binds to a 101P3A11 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-101P3A11 antibodies can be done in accordance with various approaches that have been successfully employed in the treatment of other types of cancer, including but not limited to colon cancer (Arlen et al., 1998, Crit. Rev. Immunol. 18:133–138), multiple myeloma (Ozaki et al., 1997, Blood 90:3179–3186, Tsunenari et al., 1997, Blood 90:2437–2444), gastric cancer (Kasprzyk et al., 1992, Cancer Res. 52:2771–2776), B-cell lymphoma (Funakoshi et al., 1996, J. Immunother. Emphasis Tumor Immunol. 19:93–101), leukemia (Zhong et al., 1996, Leuk. Res. 20:581–589), colorectal cancer (Moun et al., 1994, Cancer Res. 54:6160–6166; Velders et al., 1995, Cancer Res. 55:4398–4403), and breast cancer (Shepard et al., 1991, J. Clin. Immunol. 11:117–127). Some therapeutic approaches involve conjugation of naked antibody to a toxin or radioisotope, such as the conjugation of $Y^{91}$ or $I^{131}$ to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). To treat prostate cancer, for example, 101P3A11 antibodies can be administered in conjunction with radiation, chemotherapy or hormone ablation.

Although 101P3A11 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:4637–4642, 1993), Prewett et al. (International J. of Onco. 9:217–224, 1996), and Hancock et al. (Cancer Res. 51:4575–4580, 1991) describe the use of various antibodies and chemotherapeutic agents in vitro.

Cancer patients can be evaluated for the presence and level of 101P3A11 expression, preferably using immunohistochemical assessments of tumor tissue, quantitative 101P3A11 imaging, or other techniques that reliably indicate the presence and degree of 101P3A11 expression. Immunohistochemical analysis of tumor biopsies or surgical specimens is preferred for this purpose. Methods for immunohistochemical analysis of tumor tissues are well known in the art.

Anti-101P3A11 monoclonal antibodies that treat prostate and other cancers include those that initiate a potent immune response against the tumor or those that are directly cytotoxic. In this regard, anti-101P3A11 monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-101P3A11 mAbs that exert a direct biological effect on tumor growth are useful to treat cancers that express 101P3A11. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-101P3A11 mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 101P3A11 antigen with high affinity but exhibit low or no antigenicity in the patient.

Therapeutic methods of the invention contemplate the administration of single anti-101P3A11 mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-101P3A11 mAbs can be administered concomitantly with other therapeutic modalities, including but not limited to various chemotherapeutic agents, androgen-blockers, immune modulators (e.g., IL-2, GM-CSF), surgery or radiation. The anti-101P3A11 mAbs are administered in their "naked" or unconjugated form, or can have a therapeutic agent(s) conjugated to them.

Anti-101P3A11 antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-101P3A11 antibody preparation, via an acceptable route of administration such as intravenous injection (IV), typically at a dose in the range of about 0.1, 0.2, 0.3, 0.4, 0.5, 0.6, 0.7, 0.8, 0.9, 1, 2, 3, 4, 5, 6, 7, 8, 9, 10, 15, 20, or 25 mg/kg body weight. In general, doses in the range of 10–1000 mg mAb per week are effective and well tolerated.

Based on clinical experience with the Herceptin mAb in the treatment of metastatic breast cancer, an initial loading dose of approximately 4 mg/kg patient body weight IV, followed by weekly doses of about 2 mg/kg IV of the anti-101P3A11 mAb preparation represents an acceptable dosing regimen. Preferably, the initial loading dose is administered as a 90 minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 101P3A11 expression in the patient, the extent of circulating shed 101P3A11 antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 101P3A11 in a given sample (e.g. the levels of circulating 101P3A11 antigen and/or 101P3A11 expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-101P3A11 antibodies can also be used in anti-cancer therapy as a vaccine for inducing an immune response to cells expressing a 101P3A11-related protein. In particular, the generation of anti-idiotypic antibodies is well known in the art; this methodology can readily be adapted to generate anti-idiotypic anti-101P3A11 antibodies that mimic an epitope on a 101P3A11-related protein (see, for example, Wagner et al., 1997, Hybridoma 16: 33–40; Foon et al., 1995, J. Clin. Invest. 96:334–342; Herlyn et al., 1996, Cancer Immunol. Immunother. 43:65–76). Such an anti-idiotypic antibody can be used in cancer vaccine strategies.

X.C.) 101P3A11 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl- serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis *J. Immunol.* 165: 539–547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 101P3A11 antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3–4 epitopes that come from at least one tumor associated antigen (TAA). For HLA Class II a similar rationale is employed; again 3–4 epitopes are selected from at least one TAA (see, e.g., Rosenberg et al., *Science* 278:1447–1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915–3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived 101P3A11, the PADRE® universal helper T cell epitope (or multiple HTL epitopes from 101P3A11), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30–100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *BioTechniques* 6(7): 682 (1988); U.S. Pat. No. 5,279,833; WO 91/06309; and Feigner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer.

When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830–843 (QYIKAN-SKFIGITE; SEQ ID NO: 2876), *Plasmodium falciparum* circumsporozoite (CS) protein at positions 378–398 (DIEK-KIAKMEKASSVFNVVNS; SEQ ID NO: 2877), and *Streptococcus* 18 kD protein at positions 116–131 (GAVDSILG-GVATYGAA; SEQ ID NO: 2878). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed to most preferably bind most HLA-DR (human HLA class II) molecules. For instance, a pan-DR-binding epitope peptide having the formula: aKXVAAWTLKAAa (SEQ ID NO: 2879), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the ε- and α-amino groups of a lysine residue and then linked, e.g., via one or more linking residues such as Gly, Gly-Gly-, Ser, Ser—Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to ε- and α-amino groups of Lys, which is attached via linkage, e.g., Ser—Ser, to the amino terminus of the immunogenic peptide.

As another example of lipid priming of CTL responses, *E. coli* lipoproteins, such as tripalmitoyl-S-glycerylcysteinly-seryl- serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to specifically prime an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 101P3 μl. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 101P3A11.

X.D. Adoptive Immunotherapy

Antigenic 101P3A11-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7–28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses 101P3A11. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 101P3A11. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 101P3A11-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 101P3A11, a vaccine comprising 101P3A11-specific CTL may be more efficacious in killing tumor cells in patient with advanced disease than alternative embodiments.

It is generally important to provide an amount of the peptide epitope delivered by a mode of administration sufficient to effectively stimulate a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 µg and the higher value is about 10,000; 20,000; 30,000; or 50,000 µg. Dosage values for a human typically range from about 500 µg to about 50,000 µg per 70 kilogram patient. Boosting dosages of between about 1.0 µg to about 50,000 µg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. This is followed by boosting dosages of between about 1.0 µg to about 50,000 µg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., *Remington's Pharmaceutical Sciences*, $17^{th}$ Edition, A. Gennaro, Editor, Mack Publishing Co., Easton, Pa., 1985). For example a peptide dose for initial immunization can be from about 1 to about 50,000 µg, generally 100–5,000 µg, for a 70 kg patient. For example, for nucleic acids an initial immunization may be performed using an expression vector in the form of naked nucleic acid administered IM (or SC or ID) in the amounts of 0.5–5 mg at multiple sites. The nucleic acid (0.1 to 1000 µg) can also be administered using a gene gun (i.e., ballistic delivery) in accordance with regimens known in the art. Following an incubation period of 34 weeks, a booster dose is then administered. The booster can be recombinant fowlpox virus administered at a dose of $5–10^7$ to $5\times10^9$ pfu.

For antibodies, a treatment generally involves repeated administration of the anti-101P3A11 antibody preparation, via an acceptable route of administration such as intravenous injection (IV), typically at a dose in the range of about 0.1 to about 10 mg/kg body weight. In general, doses in the range of 10–500 mg mAb per week are effective and well tolerated. Moreover, an initial loading dose of approximately 4 mg/kg patient body weight IV, followed by weekly doses of about 2 mg/kg IV of the anti-101P3A11 mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 101P3A11 expression in the patient, the extent of circulating shed 101P3A11 antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 µg–1 mg, 1 mg–50 mg, 50 mg–100 mg, 100 mg–200 mg, 200 mg–300 mg, 400 mg–500 mg, 500 mg–600 mg, 600 mg–700 mg, or 1 mg–700 mg. In certain embodiments, the dose is in a range of 2–5 mg/kg body weight, e.g., with follow on weekly doses of 1–3 mg/kg; 0.5 mg, 1, 2, 3, 4, 5, 6, 7, 8, 9, 10 mg/kg body weight followed, e.g., in two, three or four weeks by weekly doses; 0.5–10 mg/kg body weight, e.g., followed in two, three or four weeks by weekly doses; 225, 250, 275, 300, 325, 350, 375, 400 mg m$^2$ of body area weekly; 1–600 mg m$^2$ of body area weekly; 225400 mg m$^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 80, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5 \times 10^{10}$ cells. A dose may also about $10^6$ cells/m$^2$ to about $10^{10}$ cells/m$^2$, or about $10^6$ cells/m$^2$ to about $10^8$ cells/m$^2$.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10–95% of active ingredient, that is, one or more peptides of the invention, and more preferably at a concentration of 25%–75%.

For aerosol administration, immunogenic peptides are preferably supplied in finely divided form along with a surfactant and propellant. Typical percentages of peptides are about 0.01%–20% by weight, preferably about 1%–10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%–20% by weight of the composition, preferably about 0.25–5%. The balance of the composition is ordinarily propellant. A carrier can also be included, as desired, as with, e.g., lecithin for intranasal delivery.

XI.) Diagnostic and Prognostic Embodiments of 101P3A11.

As disclosed herein, 101P3A11 polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described, e.g., in the Example entitled "Expression analysis of 101P3A11 in normal tissues and patient specimens").

101P3A11 can be analogized to a prostate associated antigen PSA, the archetypal marker that has been used by medical practitioners for years to identify and monitor the presence of prostate cancer (see, e.g., Merrill et al., J. Urol. 163(2): 503–5120 (2000); Polascik et al., J. Urol. August; 162(2):293–306 (1999) and Fortier et al., J. Nat. Cancer Inst. 91(19): 1635–1640(1999)). A variety of other diagnostic markers are also used in similar contexts including p53 and K-ras (see, e.g., Tulchinsky et al., Int J Mol Med 1999 Jul. 4(1):99–102 and Minimoto et al., Cancer Detect Prev 2000; 24(1): 1–12). Therefore, this disclosure of the 101P3A11 polynucleotides and polypeptides (as well as the 101P3A11 polynucleotide probes and anti-101P3A11 antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 101P3A11 polynucleotides, polypeptides, reactive T cells and antibodies are analogous to those methods from well-established diagnostic assays which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567–74(1994)) and primers (for example in PCR analysis, see, e.g., Okegawa et al., J. Urol. 163(4): 1189–1190 (2000)) to observe the presence and/or the level of PSA mRNAs in methods of monitoring PSA overexpression or the metastasis of prostate cancers, the 101P3A11 polynucleotides described herein can be utilized in the same way to detect 101P3A11 overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560–3 (2000)) or the metastasis of prostate cells (see, e.g., Alanen et al., Pathol. Res. Pract. 192(3):233–7 (1996)), the 101P3A11 polypeptides described herein can be utilized to generate antibodies for use in detecting 101P3A11 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 101P3A11 polynucleotides and/or polypeptides can be used to provide evidence of metastasis. For example, when a biological sample from tissue that does not normally contain 101P3A11-expressing cells (lymph node) is found to contain 101P3A11-expressing cells such as the 101P3A11 expression seen in LAPC4 and LAPC9, xenografts isolated from lymph node and bone metastasis, respectively, this finding is indicative of metastasis.

Alternatively 101P3A11 polynucleotides and/or polypeptides can be used to provide evidence of cancer, for example, when cells in a biological sample that do not normally express 101P3A11 or express 101P3A11 at a different level are found to express 101P3A11 or have an increased expression of 101P3A11 (see, e.g., the 101P3A11 expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 101P3A11) such as PSA, PSCA etc. (see, e.g., Alanen et al., Pathol. Res. Pract. 192(3): 233–237 (1996)).

Just as PSA polynucleotide fragments and polynucleotide variants are employed by skilled artisans for use in methods of monitoring PSA, 101P3A11 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472–476, 478–480 (1998); Robertson et al., Methods Mol. Biol. 98:121–154 (1998)). An additional illustration of the use of such fragments is provided in the Example entitled "Expression analysis of 101P3A11 in normal tissues and patient specimens", where a 101P3A11 polynucleotide fragment is used as a probe to show the expression of 101P3A11 RNAs in cancer cells. In addition, variant polynucleotide sequences are typically used as primers and probes for the corresponding mRNAs in PCR and Northern analyses (see, e.g., Sawai et al., Fetal Diagn. Ther. 1996 November–December 11(6): 407–13 and Current Protocols In Molecular Biology, Volume 2, Unit 2, Frederick M. Ausubel et al. eds., 1995)). Polynucleotide fragments and variants are useful in this context where they are capable of binding to a target polynucleotide sequence (e.g. the 101P3A11 polynucleotide shown in SEQ ID NO: 701) under conditions of high stringency.

Furthermore, PSA polypeptides which contain an epitope that can be recognized by an antibody or T cell that specifically binds to that epitope are used in methods of monitoring PSA. 101P3A11 polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the 101P3A11 biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. the 101P3A11 polypeptide shown in SEQ ID NO: 703).

As shown herein, the 101P3A11 polynucleotides and polypeptides (as well as the 101P3A11 polynucleotide probes and anti-101P3A11 antibodies or T cells used to identify the presence of these molecules) exhibit specific properties that make them useful in diagnosing cancers such as those listed in Table I. Diagnostic assays that measure the presence of 101P3A11 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233–237 (1996)), and consequently, materials such as 101P3A11 polynucleotides and polypeptides (as well as the 101P3A11 polynucleotide probes and anti-101P3A11 antibodies used to identify the presence of these molecules) must be employed to confirm metastases of prostatic origin.

Finally, in addition to their use in diagnostic assays, the 101P3A11 polynucleotides disclosed herein have a number of other utilities such as their use in the identification of oncogenetic associated chromosomal abnormalities in the chromosomal region to which the 101P3A11 gene maps (see Table XXV). Moreover, in addition to their use in diagnostic assays, the 101P3A11-related proteins and polynucleotides disclosed herein have other utilities such as their use in the forensic analysis of tissues of unknown origin (see, e.g., Takahama K Forensic Sci Int 1996 Jun. 28;80(1–2): 63–9).

Additionally, 101P3A11-related proteins or polynucleotides of the invention can be used to treat a pathologic condition characterized by the over-expression of 101P3A11. For example, the amino acid or nucleic acid sequence of FIG. 2 or FIG. 3, or fragments of either, can be used to generate an immune response to the 101P3A11 antigen. Antibodies or other molecules that react with 101P3A11 can be used to modulate the function of this molecule, and thereby provide a therapeutic benefit.

XII.) Inhibition of 101P3A11 Protein Function

The invention includes various methods and compositions for inhibiting the binding of 101P3A11 to its binding partner or its association with other protein(s) as well as methods for inhibiting 101P3A11 function.

XII.A.) Inhibition of 101P3A11 with Intracellular Antibodies

In one approach, a recombinant vector that encodes single chain antibodies that specifically bind to 101P3A11 are introduced into 101P3A11 expressing cells via gene transfer technologies. Accordingly, the encoded single chain anti-101P3A11 antibody is expressed intracellularly, binds to 101P3A11 protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137–3141; Beerli et al., 1994, J. Biol. Chem. 289: 23931–23936; Deshane et al., 1994, Gene Ther. 1: 332–337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to precisely target the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 101P3A11 in the nucleus, thereby preventing its activity within the nucleus. Nuclear targeting signals are engineered into such 101P3A11 intrabodies in order to achieve the desired targeting. Such 101P3A11 intrabodies are designed to bind specifically to a particular 101P3A11 domain. In another embodiment, cytosolic intrabodies that specifically bind to the 101P3A11 protein are used to prevent 101P3A11 from gaining access to the nucleus, thereby preventing it from exerting any biological activity within the nucleus (e.g., preventing 101P3A11 from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of 101P3A11 with Recombinant Proteins

In another approach, recombinant molecules bind to 101P3A11 and thereby inhibit 101P3A11 function. For example, these recombinant molecules prevent or inhibit 101P3A11 from accessing/binding to its binding partner(s) or associating with other protein(s). Such recombinant molecules can, for example, contain the reactive part(s) of a 101P3A11 specific antibody molecule. In a particular embodiment, the 101P3A11 binding domain of a 101P3A11 binding partner is engineered into a dimeric fusion protein, whereby the fusion protein comprises two 101P3A11 ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer associated with the expression of 101P3A11, whereby the dimeric fusion protein specifically binds to 101P3A11 and blocks 101P3A11 interaction with a binding partner. Such dimeric fusion proteins are further combined into multimeric proteins using known antibody linking technologies.

XII.C.) Inhibition of 101P3A11 Transcription or Translation

The present invention also comprises various methods and compositions for inhibiting the transcription of the 101P3A11 gene. Similarly, the invention also provides methods and compositions for inhibiting the translation of 101P3A11 mRNA into protein.

In one approach, a method of inhibiting the transcription of the 101P3A11 gene comprises contacting the 101P3A11 gene with a 101P3A11 antisense polynucleotide. In another approach, a method of inhibiting 101P3A11 mRNA translation comprises contacting the 101P3A11 mRNA with an antisense polynucleotide. In another approach, a 101P3A11 specific ribozyme is used to cleave the 101P3A11 message, thereby inhibiting translation. Such antisense and ribozyme based methods can also be directed to the regulatory regions of the 101P3A11 gene, such as the 101P3A11 promoter and/or enhancer elements. Similarly, proteins capable of inhibiting a 101P3A11 gene transcription factor are used to inhibit 101P3A11 mRNA transcription. The various polynucleotides and compositions useful in the aforementioned methods have been described above. The use of antisense and ribozyme molecules to inhibit transcription and translation is well known in the art.

Other factors that inhibit the transcription of 101P3A11 by interfering with 101P3A11 transcriptional activation are also useful to treat cancers expressing 101P3A11. Similarly, factors that interfere with 101P3A11 processing are useful to treat cancers that express 101P3A11. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 101P3A11 (i.e., antisense, ribozyme, polynucleotides encoding intrabodies and other 101P3A11 inhibitory molecules). A number of gene therapy approaches are known in the art. Recombinant vectors encoding 101P3A11 antisense polynucleotides, ribozymes, factors capable of interfering with 101P3A11 transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 101P3A11 to a binding partner, etc.

In vivo, the effect of a 101P3A11 therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402–408). For example, PCT Patent Application WO98/16628 and U.S. Pat. No. 6,107,540, Sawyers et al., published Apr. 23, 1998, describes various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Kits

For use in the diagnostic and therapeutic applications described herein, kits are also within the scope of the invention. Such kits can comprise a carrier, package or container that is compartmentalized to receive one or more containers such as vials, tubes, and the like, each of the container(s) comprising one of the separate elements to be used in the method. For example, the container(s) can comprise a probe that is or can be detectably labeled. Such probe can be an antibody or polynucleotide specific for a 101P3A11-related protein or a 101P3A11 gene or message, respectively. Where the method utilizes nucleic acid hybridization to detect the target nucleic acid, the kit can also have containers containing nucleotide(s) for amplification of the target nucleic acid sequence and/or a container comprising a reporter-means, such as a biotin-binding protein, such as avidin or streptavidin, bound to a reporter molecule, such as an enzymatic, florescent, or radioisotope label. The kit can include all or part of the amino acid sequence of FIG. 2 or FIG. 3 or analogs thereof, or a nucleic acid molecules that encodes such amino acid sequences or which hybridize to such sequences.

The kit of the invention will typically comprise the container described above and one or more other containers comprising materials desirable from a commercial and user standpoint, including buffers, diluents, filters, needles, syringes, and package inserts with instructions for use. Any physical object in a kit of the invention, e.g. syringe or vial, can have a label affixed thereto. A label or package insert can have instructions for use in human administration printed thereon. Thus, a label can be present on the container to indicate that the composition is used for a specific therapy or non-therapeutic application, and can also indicate directions for either in vivo or in vitro use, such as those described above. Directions and or other information can also be included on an insert that is included with the kit.

EXAMPLES

Various aspects of the invention are further described and illustrated by way of the several examples that follow, none of which are intended to limit the scope of the invention.

Example 1

Expression Analysis of 101P3A11 in Normal Tissues and Patient Specimens

Figure 10B:
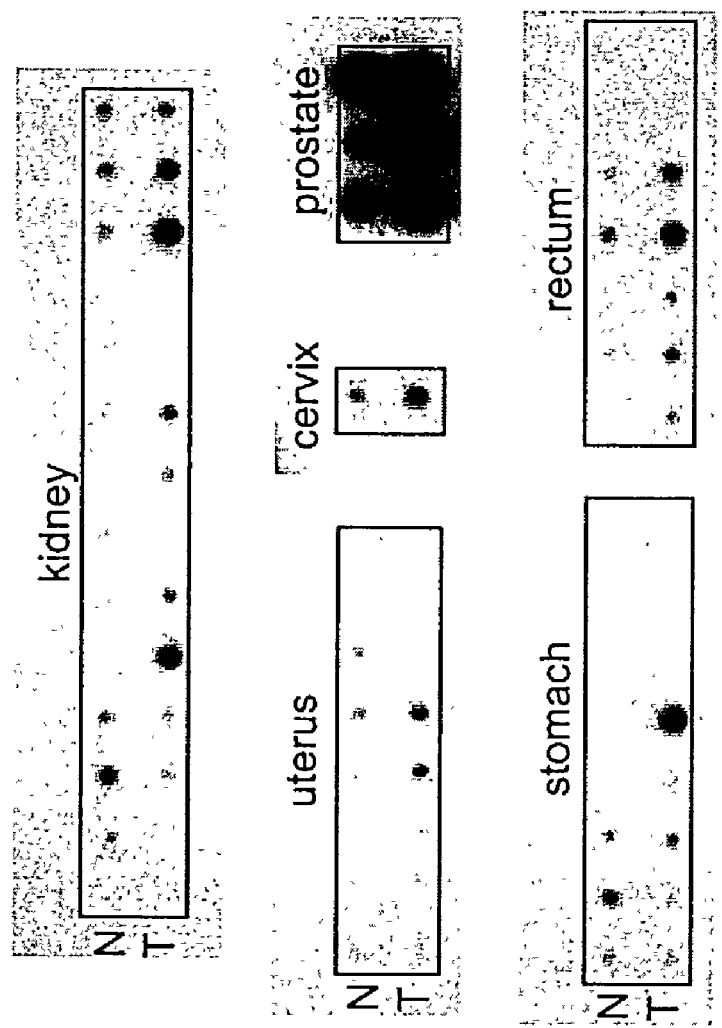
FIG. 10B. Expression of 101P3A11 in human cancers demonstrated by dot blot analysis of tumor RNA (T) and normal RNA (N) matched samples using patient-derived amplified cDNAs. Up-regulation of PHOR-1 expression was found in 3 of 3 prostate cancer patients, 6 of 14 kidney cancer patients, 2 of 8 uterine cancer patients, 3 of 8 stomach cancer patients and 7 of 7 rectal cancer patients.

Analysis of 101P3A11 by RT-PCR is shown in FIG. 10A. First strand cDNA was prepared from vital pool 1 (VP1: liver, lung and kidney), vital pool 2 (VP2, pancreas, colon and stomach), prostate xenograft pool, prostate cancer pool, kidney cancer pool, colon cancer pool, breast cancer pool, and cancer metastasis pool. Normalization was performed by PCR using primers to actin and GAPDH. Semi-quantitative PCR, using primers to 101P3A11, was performed at 30 cycles of amplification. Expression of 101P3A11 was observed in prostate xenograft pool, prostate cancer pool, kidney cancer pool, colon cancer pool, breast cancer pool, and cancer metastasis pool, but not in VP1 and VP2. Dot blots using patient-derived amplified cDNAs (Clontech, CA) show upregulation of PHOR-1 in 3/3 prostate cancer patients, 6/14 kidney cancer patients, 2/8 uterine cancer, 1/1 cervical cancer, 3/8 stomach cancer, and in 7/7 rectal cancer patients (FIG. 10B). Expression of 101P3A11 was assayed in a panel of human patient cancer specimens (FIG. 11). RNA was extracted from a pool of three prostate cancer tumors, kidney cancer tumors, colon cancer tumors, breast cancer tumors, and cancer metastasis pool derived from cancer patients, as well as from normal prostate (NP), normal bladder (NB), normal kidney (NK) and normal colon (NC). Northern blots with 10 μg of total RNA/lane were probed with a 101P3A11 sequence fragment. Size standards in kilobases (kb) are indicated on the side. The results show expression of 101P3A11 in prostate cancer tumors, kidney cancer tumors, colon cancer tumors, breast cancer tumors, cancer metastasis pool, bladder cancer pool, and in the normal prostate but not in the other normal tissues.

Figure 12A:
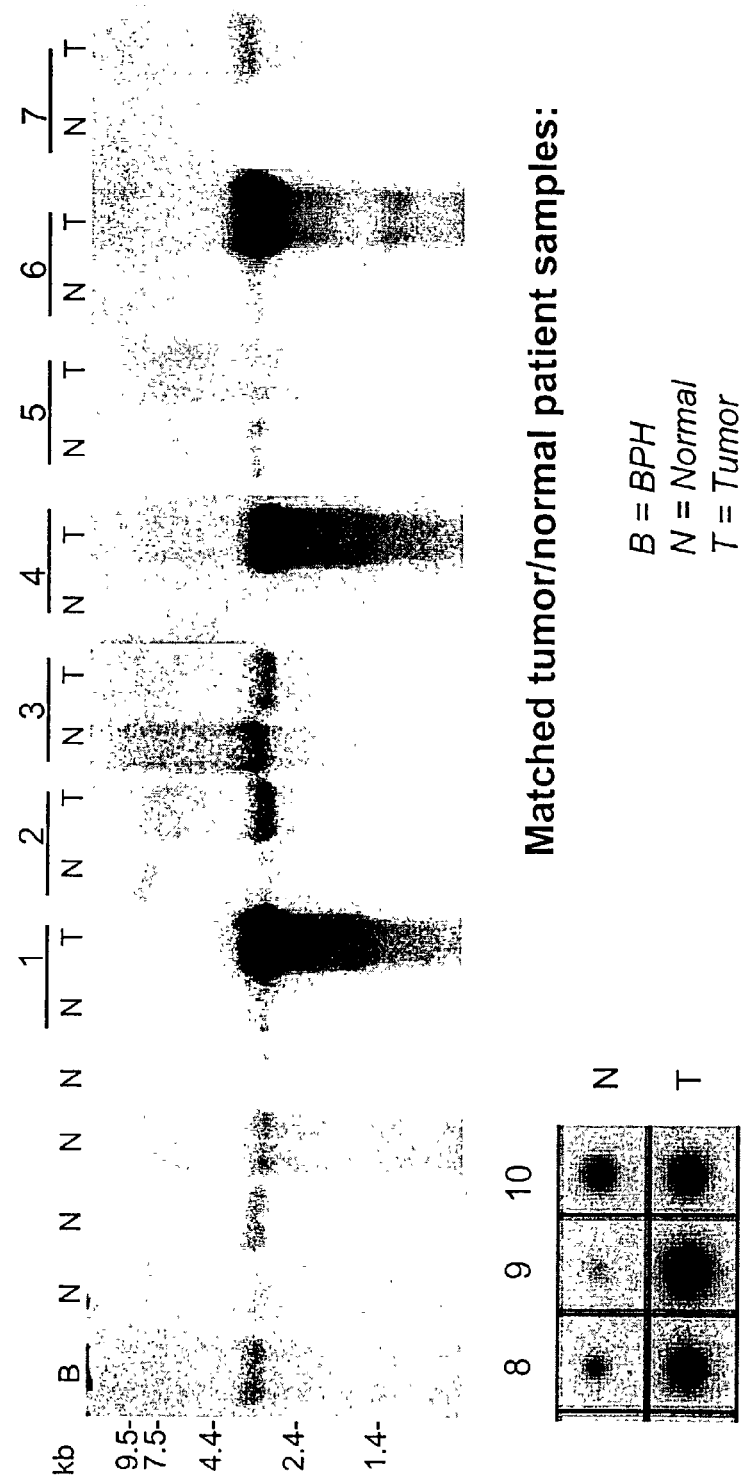
FIG. 12A. Expression of 101P3A11 in prostate cancer patient specimens. RNA was extracted from prostate tumors (T) and their normal adjacent tissues (Nat) derived from prostate cancer patients. Northern blots with 10 μg of total RNA/lane were probed with 101P3A11 sequences. Results show upregulated expression of 101P3A11 in 8 of 10 tumor specimens.

Northern blot analysis on individual prostate patient tumor specimens is shown in FIG. 12A. RNA was extracted from prostate tumors (T) and their normal adjacent tissues (Nat) derived from prostate cancer patients. Northern blots with 10 μg of total RNA/lane were probed with 101P3A11 sequence. Results showed expression of 101P3A11 in all three patient specimens, and expression is especially upregulated in one of the three prostate tumor tissues.

Figure 12B:
FIG. 12B. Photomicrograph showing 101P3A11 expression in prostatic intraepithelial neoplasia (PIN) by in situ hybridization with an anti-sense 101P3A11 riboprobe.
Figure 12C:
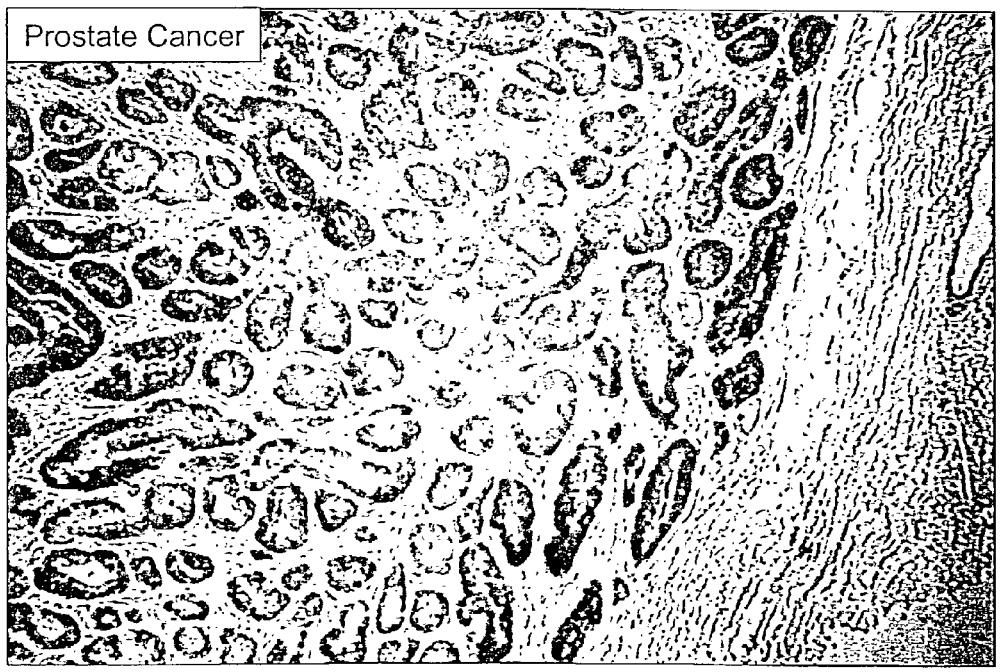
FIG. 12C. Photomicrograph showing 101P3A11 expression in prostate cancer tissue by in situ hybridization with an anti-sense 101P3A11 riboprobe.
Figure 12D:
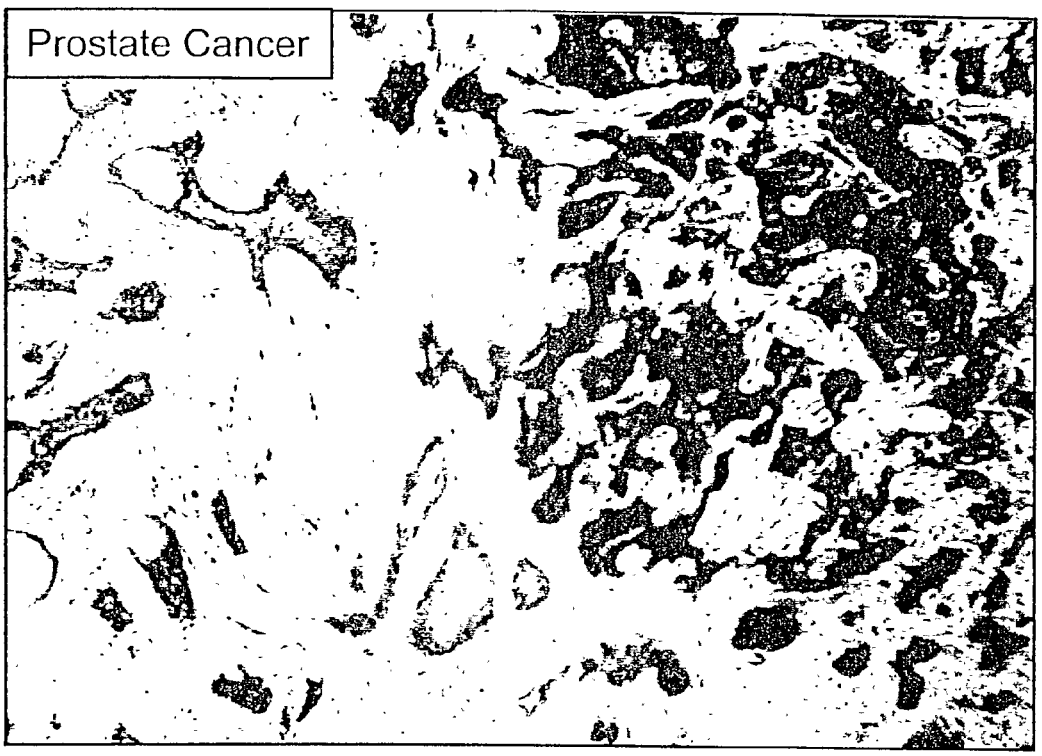
FIG. 12D. Photomicrograph showing 101P3A11 expression in prostate cancer by in situ hybridization with an anti-sense 101P3A11 riboprobe. Note up-regulation of expression relative to normal prostate, FIG. 12E.
Figure 12E:
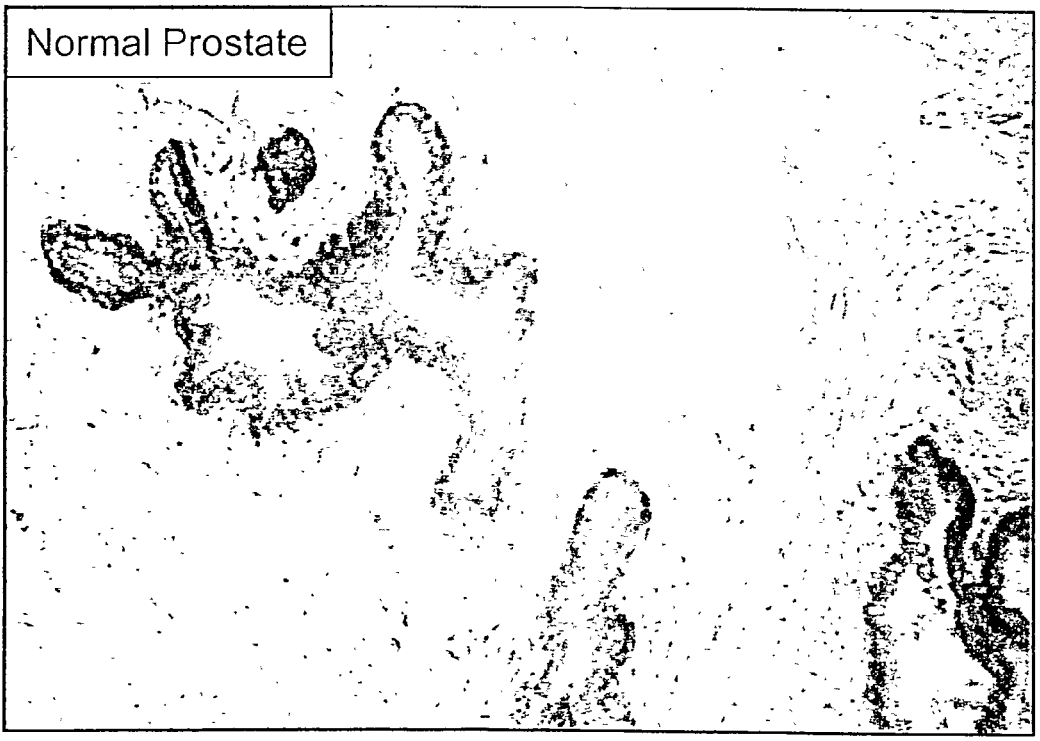
FIG. 12E. Photomicrograph showing 101P3A11 expression in normal prostate by in situ hybridization with an anti-sense 101P3A11 riboprobe.

RNA in situ analysis using anti-sense 101P3A11 riboprobe showed significant glandular epithelial and basal cell expression in normal prostate (4/4), PIN (1/1), and prostate cancer (6/6) patients. 101P3A11 sense riboprobe had little to no staining. The RNA in situ staining in PIN and prostate cancer is shown in FIGS. 12B and 12C. The staining intensity in the cancer cells was generally higher than that observed in normal glands (FIGS. 12D and 12E). The RNA in situ results also demonstrate that the expression observed in the prostate tissues is in the glandular epithelia, basal cells, and cancer cells.

Figure 40A:
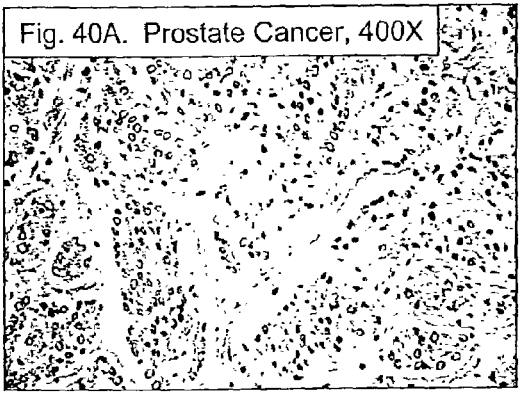
FIGS. 40A–40F. Photomicrographs showing immunohistochemical analysis using anti-101P3A11 (peptide 1; amino acids 1–14) rabbit polyclonal antibody on formalin fixed and paraffin embedded prostate cancer tissues (FIG. 40A); anti-101P3A11 (peptide 1; amino acids 1–14) rabbit polyclonal antibody on formalin fixed and paraffin embedded prostate cancer cell line, LNCaP (FIG. 40B); anti-101P3A11 (peptide 1; amino acids 1–14) rabbit polyclonal antibody on formalin fixed and paraffin embedded prostate cancer tissues (FIG. 40C); anti-101P3A11 (peptide 1; amino acids 1–14) rabbit polyclonal antibody on formalin fixed and paraffin embedded normal prostate (FIG. 40D); anti-101P3A11 (peptide 1; amino acids 1–14) rabbit polyclonal antibody on formalin fixed and paraffin embedded prostate cancer tissues (FIG. 40E); and anti-101P3A11 (peptide 1; amino acids 1–14) rabbit polyclonal antibody on formalin fixed and paraffin embedded normal prostate (FIG. 40F).
Figure 40B:
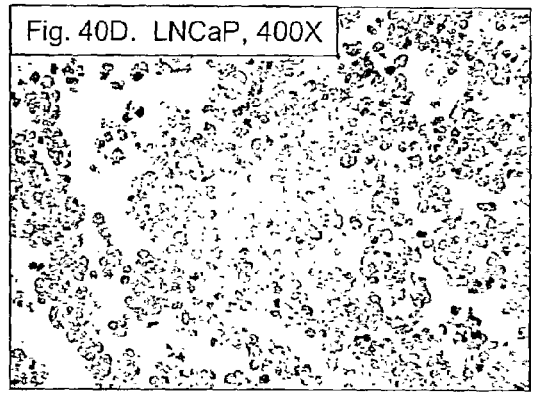
Figure 40C:
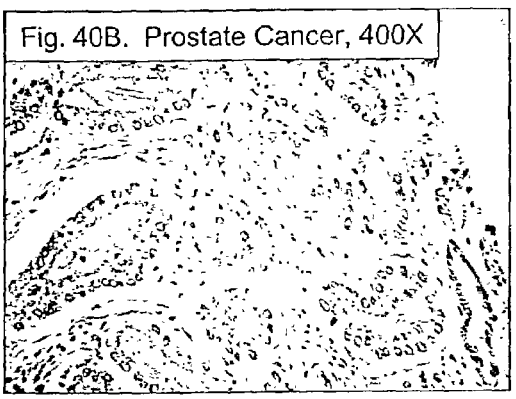
Figure 40D:
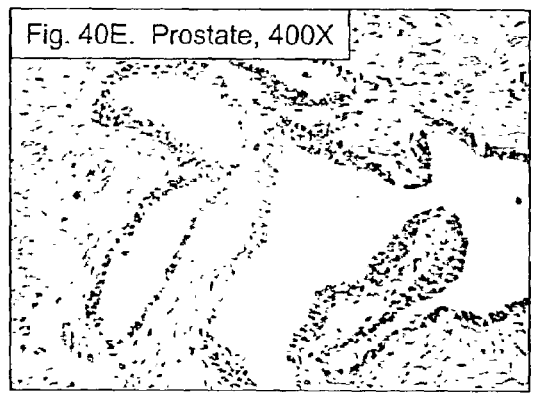
Figure 40E:
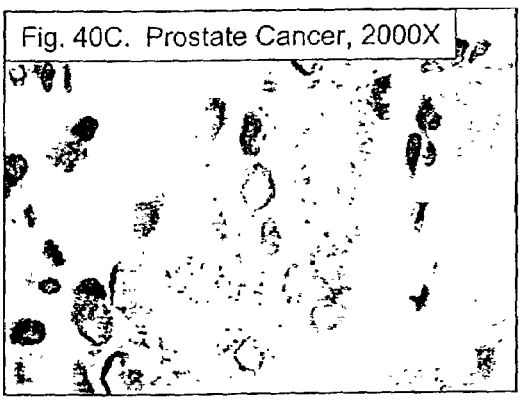
Figure 40F:
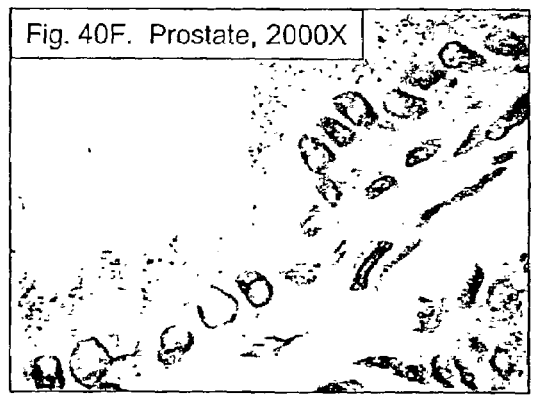

Endogenous expression of the 101P3A11 protein is demonstrated in the immunohistochemistry analysis of the anti-101P3A11 (PEPTIDE 1: amino acids 1–14) rabbit polyclonal antibody (FIGS. 40A–40F). Staining in prostate cancer is greater than the staining observed in normal prostate. The staining is localized apically within the luminal epithelia of the normal prostate (FIGS. 40E and 40F). The staining observed in prostate cancer is also localized apically in low to intermediate grade cancer (FIGS. 40B and 40C) and throughout all cells of more advanced prostate cancer (FIG. 40A). Staining was observed in 19/20 normal prostate patients and in all of the nineteen prostate cancer patients analyzed. The prostate cancer cell line, LNCaP also shows similar staining (FIGS. 40D and 40F) in almost all cells.

In addition, the present protocol was used to identify endogenous expression of the 101P3A11 protein in prostate cancer, bladder cancer, kidney cancer, colon cancer, lung cancer, and breast cancer. Immunohistochemical analysis was performed with the anti-101P3A11 (PEPTIDE 1: amino acids 1–14) rabbit polyclonal antibody (prostate cancer, FIG. 41A; bladder cancer, FIG. 41B; kidney cancer, FIG. 41C; colon cancer, lung cancer, FIG. 41E; and breast cancer, FIG. 41F). Specific staining is observed in tumor cells of the six cancers analyzed.

Expression of 101P3A11 was also detected in the tumors of two colon cancer patients but not in normal colon tissues (FIG. 13), and in five out of six kidney tumors isolated from kidney cancer patients (FIG. 14). The expression detected in normal adjacent tissues (isolated from diseased tissues) but not in normal tissues of the kidney (isolated from healthy donors) indicates that these tissues are not fully normal and that 101P3A11 is expressed in early stage tumors. In order to assay for androgen regulation of 101P3A11 expression, LAPC-9 cells were grown in charcoal-stripped medium and stimulated with the synthetic androgen mibolerone, for either 14 or 24 hours (FIG. 15A, FIG. 15B, and FIG. 15C). Northern blots with 10 μg of total RNA/lane were probed with the 101P3A11 sequences (FIG. 15A). A picture of the ethidium-bromide staining of the RNA gel is also presented (FIG. 15C). Results showed expression of 101P3A11 is not regulated by androgen. The experimental samples were confirmed by testing for the expression of the androgen-regulated prostate cancer gene PSA (FIG. 15B). This experiment showed that, as expected, PSA levels go down in presence of charcoal-stripped serum, and expression is induced at 14 and 24 hours in presence of mibolerone.

Analysis of androgen regulation of 101P3A11 in vivo is shown in FIG. 16. Male mice were injected with LAPC-9AD tumor cells. When tumors reached a palpable size, mice were castrated and tumors harvested at different time points following castration. RNA was isolated from the xenograft tissues. Northern blots with 10 μg of total RNA/lane were probed with 101P3A11 sequences. Size standards in kilobases (kb) are indicated on the side. A picture of the ethidium-bromide staining of the RNA gel is also presented in FIG. 16. The results showed that expression of 101P3A11 was not affected by androgen deprivation, and therefore, is not androgen regulated.

Example 2

Production of Recombinant 101P3A11 in Prokaryotic and Yeast Systems

To express recombinant 101P3A11 in prokaryotic cells, the full or partial length 101P3A11 cDNA sequences can be cloned into any one of a variety of expression vectors known in the art. One or more of the following regions of 101P3A11 are expressed in these constructs, amino acids 1 to 317; or any 8,9, 10, 11, 12, 13, 14, 15, 16, 17, 18, 19, 20, 21, 22, 23, 24, 25, 26, 27, 28, 29, 30 or more contiguous amino acids from 101P3A11, variants, or analogs thereof.

A. In Vitro Transcription and Translation Constructs:

pCRII: To generate 101P3A11 sense and anti-sense RNA probes for RNA in situ investigations, pCRII constructs (Invitrogen, Carlsbad, Calif.) are generated encoding either all or fragments of the 101P3A11 cDNA. The pCRII vector has Sp6 and T7 promoters flanking the insert to drive the transcription of 101P3A11 RNA for use as probes in RNA in situ hybridization experiments. These probes are used to analyze the cell and tissue expression of 101P3A11 at the RNA level. Transcribed 101P3A11RNA representing the cDNA amino acid coding region of the 101P3A11 gene is used in in vitro translation systems such as the TnT™ Coupled Reticulolysate System (Promega, Corp., Madison, Wis.) to synthesize 101P3A11 protein.

B. Bacterial Constructs:

pGEX Constructs: To generate recombinant 101P3A11 proteins in bacteria that are fused to the Glutathione S-transferase (GST) protein, all or parts of the 101P3A11 cDNA protein coding sequence are fused to the GST gene by cloning into pGEX-6P-1 or any other GST-fusion vector of the pGEX family (Amersham Pharmacia Biotech, Piscataway, N.J.). These constructs allow controlled expression of recombinant 101P3A11 protein sequences with GST fused at the amino-terminus and a six histidine epitope (6× His) at the carboxyl-terminus. The GST and 6× His tags permit purification of the recombinant fusion protein from induced bacteria with the appropriate affinity matrix and allow recognition of the fusion protein with anti-GST and anti-His antibodies. The 6× His tag is generated by adding 6 histidine codons to the cloning primer at the 3' end, e.g., of the open reading frame (ORF). A proteolytic cleavage site, such as the PreScission™ recognition site in pGEX-6P-1, can be employed that permits cleavage of the GST tag from 101P3A11-related protein. The ampicillin resistance gene and pBR322 origin permit selection and maintenance of the pGEX plasmids in $E.$ $coli.$ In one embodiment, amino acids 86–317 are cloned into the pGEX-2T expression vector, the protein is expressed and purified.

pMAL Constructs: To generate, in bacteria, recombinant 101P3A11 proteins that are fused to maltose-binding protein (MBP), all or parts of the 101P3A11 cDNA protein coding sequence are fused to the MBP gene by cloning into the pMAL-c2X and pMAL-p2X vectors (New England Biolabs, Beverly, Mass.). These constructs allow controlled expression of recombinant 101P3A11 protein sequences with MBP fused at the amino-terminus and a 6× His epitope tag at the carboxyl-terminus. The MBP and 6× His tags permit purification of the recombinant protein from induced bacteria with the appropriate affinity matrix and allow recognition of the fusion protein with anti-MBP and anti-His antibodies. The 6× His epitope tag is generated by adding 6 histidine codons to the 3' cloning primer. A Factor Xa recognition site permits cleavage of the pMAL tag from 101P3A11. The pMAL-c2X and pMAL-p2X vectors are optimized to express the recombinant protein in the cytoplasm or periplasm respectively. Periplasm expression enhances folding of proteins with disulfide bonds. In one embodiment, amino acids 86–310 is cloned into the pMAL-c2X expression vector, the protein is expressed and purified.

pET Constructs: To express 101P3A11 in bacterial cells, all or parts of the 101P3A11 cDNA protein coding sequence are cloned into the pET family of vectors (Novagen, Madison, Wis.). These vectors allow tightly controlled expression of recombinant 101P3A11 protein in bacteria with and without fusion to proteins that enhance solubility, such as NusA and thioredoxin (Trx), and epitope tags, such as 6× His and S-Tag™ that aid purification and detection of the recombinant protein. For example, constructs are made utilizing pET NusA fusion system 43.1 such that regions of the 101P3A11 protein are expressed as amino-terminal fusions to NusA.

C. Yeast Constructs:

pESC Constructs: To express 101P3A11 in the yeast species $Saccharomyces$ $cerevisiae$ for generation of recombinant protein and functional studies, all or parts of the 101P3A11 cDNA protein coding sequence are cloned into the pESC family of vector each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is used to confirm protein—protein interactions of 101P3A11. In addition, expression in yeast yields similar post-translational modifications, such as glycosylations and phosphorylations, that are found when expressed in eukaryotic cells.

pESP Constructs: To express 101P3A11 in the yeast species $Saccharomyces$ pombe, all or parts of the 101P3A11 cDNA protein coding sequence are cloned into the pESP family of vectors. These vectors allow controlled high level expression of a 101P3A11 protein sequence that is fused at either the amino terminus or at the carboxyl terminus to GST which aids purification of the recombinant protein. A Flag™ epitope tag allows detection of the recombinant protein with anti-Flag™ antibody.

Example 3

Production of Recombinant 101P3A11 in Higher Eukaryotic Systems

A. Mammalian Constructs:

To express recombinant 101P3A11 in eukaryotic cells, full or partial length 101P3A11 cDNA sequences can be cloned into any one of a variety of expression vectors known in the art. One or more of the following regions of 101P3A11 are expressed in these constructs, amino acids 1 to 317; or any 5, 6, 7, 8, 9, 10, 11, 12, 13, 14, 15, 16, 17, 18, 19, 20, 21, 22, 23, 24, 25, 26, 27, 28, 29, 30 or more contiguous amino acids from 101P3A11, variants, or analogs thereof.

The constructs can be transfected into any one of a wide variety of mammalian cells such as 293T cells. Transfected 293T cell lysates can be probed with the anti-101P3A11 polyclonal serum, described herein.

pcDNA/HisMax Constructs: To express 101P3A11 in mammalian cells, the 101P3A11 ORF was cloned into pcDNA4/HisMax Version A (Invitrogen, Carlsbad, Calif.). Protein expression is driven from the cytomegalovirus (CMV) promoter and the SP 16 translational enhancer. The recombinant protein has Xpress™ and six histidine (6× His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in $E.$ $coli.$ pcDNA3.1/MycHis Constructs: To express 101P3A11 in mammalian cells, the 101P3A11 ORF, with a consensus Kozak translation initiation site, was cloned into pcDNA3./ MycHis Version A (Invitrogen, Carlsbad, Calif.). Protein expression is driven from the cytomegalovirus (CMV) promoter. The recombinant proteins have the myc epitope and 6× His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in E. coli.

pcDNA3.1/CT-GFP-TOPO Construct: To express 101P3A11 in mammalian cells and to allow detection of the recombinant proteins using fluorescence, the 101P3A11 ORF, with a consensus Kozak translation initiation site, was cloned into pcDNA3.1/CT-GFP-TOPO (Invitrogen, CA). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in E. coli. Additional constructs with an amino-terminal GFP fusion are made in pcDNA3.1/NT-GFP-TOPO spanning the entire length of the 101P3A11 proteins.

PAPtag: The 101P3A11 ORF, or portions thereof, of 101P3A11 are cloned into pAPtag-5 (GenHunter Corp. Nashville, Tenn.). This construct generates an alkaline phosphatase fusion at the carboxyl-terminus of the 101P3A11 proteins while fusing the IgGκ signal sequence to the amino-terminus. Constructs are also generated in which alkaline phosphatase with an amino-terminal IgGκ signal sequence is fused to the amino-terminus of 101P3A11 proteins. The resulting recombinant 101P3A11 proteins are optimized for secretion into the media of transfected mammalian cells and can be used to identify proteins such as ligands or receptors that interact with the 101P3A11 proteins. Protein expression is driven from the CMV promoter and the recombinant proteins also contain myc and 6× His epitopes fused at the carboxyl-terminus that facilitates detection and purification. The Zeocin resistance gene present in the vector allows for selection of mammalian cells expressing the recombinant protein and the ampicillin resistance gene permits selection of the plasmid in E. coli.

ptag5: The 101P3A11 ORF, or portions thereof, of 101P3A11 are cloned into pTag-5. This vector is similar to pAPtag but without the alkaline phosphatase fusion. This construct generated 101P3A11 protein with an amino-terminal IgGK signal sequence and myc and 6× His epitope tags at the carboxyl-terminus that facilitate detection and affinity purification. The resulting recombinant 101P3A11 protein was optimized for secretion into the media of transfected mammalian cells, and was used as immunogen or ligand to identify proteins such as ligands or receptors that interact with the 101P3A11 proteins. Protein expression is driven from the CMV promoter. The Zeocin resistance gene present in the vector allows for selection of mammalian cells expressing the protein, and the ampicillin resistance gene permits selection of the plasmid in E. coli.

PsecFc: The 101P3A11 ORF, or portions thereof, of 101P3A11 are also cloned into psecFc. The psecFc vector was assembled by cloning the human immunoglobulin G1 (IgG) Fc (hinge, CH2, CH3 regions) into pSecTag2 (Invitrogen, California). This construct generates an IgG1 Fc fusion at the carboxyl-terminus of the 101P3A11 proteins, while fusing the IgGκ signal sequence to N-terminus. 101P3A11 fusions utilizing the murine IgG1 Fc region are also used. The resulting recombinant 101P3A11 proteins are optimized for secretion into the media of transfected mammalian cells, and can be used as immunogens or to identify proteins such as ligands or receptors that interact with the 101P3A11 protein. Protein expression is driven from the CMV promoter. The hygromycin resistance gene present in the vector allows for selection of mammalian cells that express the recombinant protein, and the ampicillin resistance gene permits selection of the plasmid in E. coli.

The amino acid region 159–202 of the 101P3A11 ORF was cloned into psecFc. The resulting recombinant 101P3A11(159–202)-psecFc construct was transfected into 293T and Cos-7 cells, and the expression of recombinant 101P3A11(159–202)-psecFc protein assayed by Western blotting (FIG. 17). Results show that 101P3A11(159–202)-psecFc fusion protein was expressed in the lysates of both 293T and Cos-7 cells. The 101P3A11(159–202)-psecFc fusion protein was also secreted and detected in the culture supernatants of both cell types.

pSRα Constructs: To generate mammalian cell lines that express 101P3A11, constitutively, the ORF of 101P3A11 was cloned into pSRα constructs. Amphotropic and ecotropic retroviruses were generated by transfection of pSRα constructs into the 293T-10A1 packaging line or co-transfection of pSRα and a helper plasmid (containing deleted packaging sequences) into the 293 cells, respectively. The retrovirus was used to infect a variety of mammalian cell lines, resulting in the integration of the cloned gene, 101P3A11, into the host cell lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in E. coli. FIG. 18 shows that 101P3A11 was expressed using the pSRα retroviral vector in the cell line 300.19. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of 101P3A11 sequences to allow detection using anti-Flag antibodies. For example, the FLAG™ sequence 5' gat tac aag gat gac gac gat aag 3' is added to cloning primer at the 3' end of the ORF. Additional pSRα constructs are made to produce both amino-terminal and carboxyl-terminal GFP and myc/6× His fusion proteins of the full-length 101P3A11 proteins.

Additional Viral Vectors: Additional constructs are made for viral-mediated delivery and expression of 101P3A11. High virus titer leading to high level expression of 101P3A11 is achieved in viral delivery systems such as adenoviral vectors and herpes amplicon vectors. The 101P3A11 coding sequences or fragments thereof are amplified by PCR and subcloned into the AdEasy shuttle vector (Stratagene). Recombination and virus packaging are performed according to the manufacturer's instructions to generate adenoviral vectors. Alternatively, 101P3A11 coding sequences or fragments thereof are cloned into the HSV-1 vector (Imgenex) to generate herpes viral vectors. The viral vectors are thereafter used for infection of various cell lines such as SCaBER, NIH 3T3, 293 or rat-1 cells.

Regulated Expression Systems: To control expression of 101P3A11 in mammalian cells, coding sequences of 101P3A11, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant 101P3A11. These vectors are thereafter used to control expression of 101P3A11 in various cell lines such as SCaBER, NIH 3T3, 293 or rat-1 cells.

B. Baculovirus Expression Systems

To generate recombinant 101P3A11 proteins in a baculovirus expression system, 101P3A11 ORF, or portions thereof, are cloned into the baculovirus transfer vector pBlueBac 4.5 (Invitrogen), which provides a His-tag at the N-terminus. Specifically, pBlueBac-101P3A11 is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant 101P3A11 protein is then generated by infection of HighFive insect cells (Invitrogen) with purified baculovirus. Recombinant 101P3A11 protein can be detected using anti-101P3A11 or anti-His-tag antibody. 101P3A11 protein can be purified and used in various cell-based assays or as immunogen to generate polyclonal and monoclonal antibodies specific for 101P3A11.

Example 4

Antigenicity Profiles and Secondary Structure

FIG. 5, FIG. 6, FIG. 7, FIG. 8, and FIG. 9 depict graphically five amino acid profiles of the 101P3A11 amino acid sequence, each assessment available by accessing the ProtScale website (URL www.expasy.ch/cgi-bin/protscale.pl) on the ExPasy molecular biology server.

These profiles: FIG. 5, Hydrophilicity, (Hopp T. P., Woods K. R., 1981. Proc. Natl. Acad. Sci. U.S.A. 78:3824–3828); FIG. 6, Hydropathicity, (Kyte J., Doolittle R. F., 1982. J. Mol. Biol. 157:105–132); FIG. 7, Percentage Accessible Residues (Janin J., 1979 Nature 277:491–492); FIG. 8, Average Flexibility, (Bhaskaran R., and Ponnuswamy P. K., 1988. Int. J. Pept. Protein Res. 32:242–255); FIG. 9, Beta-turn (Deleage, G., Roux B. 1987 Protein Engineering 1:289–294); and optionally others available in the art, such as on the ProtScale website, were used to identify antigenic regions of the 101P3A11 protein. Each of the above amino acid profiles of 101P3A11 were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus are available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed portions of the protein and thus are accessible to immune recognition, such as by antibodies.

Antigenic sequences of the 101P3A 11 protein indicated, e.g., by the profiles set forth in FIG. 5, FIG. 6, FIG. 7, FIG. 8, and/or FIG. 9 are used to prepare immunogens, either peptides or nucleic acids that encode them, to generate anti-101P3A11 antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the 101P3A11 protein. In particular, peptide immunogens of the invention can comprise, a peptide region of at least 5 amino acids of FIG. 2 in any whole number increment up to 317 that includes an amino acid position having a value greater than 0.5 in the Hydrophilicity profile of FIG. 5; a peptide region of at least 5 amino acids of FIG. 2 in any whole number increment up to 317 that includes an amino acid position having a value less than 0.5 in the Hydropathicity profile of FIG. 6; a peptide region of at least 5 amino acids of FIG. 2 in any whole number increment up to 317 that includes an amino acid position having a value greater than 0.5 in the Percent Accessible Residues profile of FIG. 7; a peptide region of at least 5 amino acids of FIG. 2 in any whole number increment up to 317 that includes an amino acid position having a value greater than 0.5 in the Average Flexibility profile on FIG. 8; and, a peptide region of at least 5 amino acids of FIG. 2 in any whole number increment up to 317 that includes an amino acid position having a value greater than 0.5 in the Beta-turn profile of FIG. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structure of 101P3A11, namely the predicted presence and location of alpha helices, extended strands, and random coils, is predicted from the primary amino acid sequence using the HNN—Hierarchical Neural Network method (Guermeur, 1997, http://pbil.ibcp.fr/cgi-bin/npsa_automat.pl?page=npsa_nn.html), accessed from the ExPasy molecular biology server http://www.expasy.ch/tools/. The analysis indicates that 101P3A11 is composed 47.95% alpha helix, 21.45% extended strand, and 30.60% random coil (FIG. 19A).

Analysis for the potential presence of transmembrane domains in 101P3A11 was carried out using a variety of transmembrane prediction algorithms accessed from the ExPasy molecular biology server http://www.expasy.ch/tools. The programs predict the presence of 7 transmembrane domains in 101P3A11, consistent with the structure of a G-protein coupled receptor. Shown graphically in FIG. 19A are the results of analysis using the TMpred (FIG. 19B) and TMHMM (FIG. 19C) prediction programs depicting the location of the 7 transmembrane domains. The results of each program, namely the amino acids encoding the transmembrane domains are summarized in Table XXV.

Example 5

Generation of 101P3A11 Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with the full length 101P3A11 protein, computer algorithms are employed in design of immunogens that, based on amino acid sequence analysis are antigenic and available for recognition by the immune system of the immunized host (see the Example entitled "Antigenicity Profiles and Secondary Structure"). Such regions would generally be hydrophilic, flexible, in beta-turn conformations, and/or exposed on the surface of the protein (see, e.g., FIG. 5, FIG. 6, FIG. 7, FIG. 8, or FIG. 9 for amino acid profiles that indicate such regions of 101P3A11).

For example, 101P3A11 recombinant bacterial fusion proteins or peptides containing hydrophilic, flexible, beta-turn regions of the 101P3A11 amino acid sequence, such as amino acids 1–23, plus or minus 1–10 amino acids at available termini, and amino acids 159–202, plus or minus 1–10 amino acids at available termini, are used as antigens to generate polyclonal antibodies in New Zealand White rabbits. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids 1–23 of 101P3A11 is conjugated to KLH and used to immunize the rabbit. Alternatively the immunizing agent may include all or portions of the 101P3A11 protein, analogs or fusion proteins thereof. For example, the 101P3A11 amino acid sequence can be fused using recombinant DNA techniques to any one of a variety of fusion protein partners that are well known in the art, such as glutathione-S-transferase (GST) and HIS tagged fusion proteins. Such fusion proteins are purified from induced bacteria using the appropriate affinity matrix.

In one embodiment, a GST-fusion protein encoding amino acids 86–317, plus or minus 1–10 amino acids at available termini, is produced and purified and used as immunogen. Other recombinant bacterial fusion proteins that may be employed include maltose binding protein, LacZ, thioredoxin, NusA, or an immunoglobulin constant region (see the section entitled "Production of 101P3A11 in Prokaryotic Systems" and Current Protocols In Molecular Biology, Volume 2, Unit 16, Frederick M. Ausubul et al. eds., 1995; Linsley, P. S., Brady, W., Urnes, M., Grosmaire, L., Damle, N., and Ledbetter, L. (1991) J. Exp. Med. 174, 561–566).

In addition to bacterial derived fusion proteins, mammalian expressed protein antigens are also used. These antigens are expressed from mammalian expression vectors such as the Tag5 and Fc-fusion vectors (see the section entitled "Production of Recombinant 101P3A11 in Eukaryotic Systems"), and retain post-translational modifications such as glycosylations found in native protein. In one embodiment, amino acids 159–202 is cloned into the Tag5 mammalian secretion vector. The recombinant protein is purified by metal chelate chromatography from tissue culture supernatants of 293T cells stably expressing the recombinant vector. The purified Tag5 101P3A11 protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 µg, typically 100–200 µg, of fusion protein or peptide conjugated to KLH mixed in complete Freund's adjuvant (CFA). Rabbits are then injected subcutaneously every two weeks with up to 200 µg, typically 100–200 µg, of the immunogen in incomplete Freund's adjuvant (IFA). Test bleeds are taken approximately 7–10 days following each immunization and used to monitor the titer of the antiserum by ELISA.

To test reactivity and specificity of immune serum, such as the rabbit serum derived from immunization with Tag5 101P3A11 encoding amino acids 159–202, the full-length 101P3A11 cDNA is cloned into pcDNA 3.1 myc-his expression vector (Invitrogen, see the Example entitled "Production of Recombinant 101P3A11 in Eukaryotic Systems"). After transfection of the constructs into 293T cells, cell lysates are probed with the anti-101P3A11 serum and with anti-His antibody (Santa Cruz Biotechnologies, Santa Cruz, Calif.) to determine specific reactivity to denatured 101P3A11 protein using the Western blot technique. Immunoprecipitation and flow cytometric analyses of 293T and other recombinant 101P3A11-expressing cells determine recognition of native protein by the antiserum. In addition, Western blot, immunoprecipitation, fluorescent microscopy, and flow cytometric techniques using cells that endogenously express 101P3A11 are carried out to test specificity.

The anti-serum from the Tag5 101P3A11 immunized rabbit is affinity purified by passage over a column composed of the Tag5 antigen covalently coupled to Affigel matrix (BioRad, Hercules, Calif.). The serum is then further purified by protein G affinity chromatography to isolate the IgG fraction. Serum from rabbits immunized with fusion proteins, such as GST and MBP fusion proteins, are purified by depletion of antibodies reactive to the fusion partner sequence by passage over an affinity column containing the fusion partner either alone or in the context of an irrelevant fusion protein. Sera from other His-tagged antigens and peptide immunized rabbits as well as fusion partner depleted sera are affinity purified by passage over a column matrix composed of the original protein immunogen or free peptide.

Example 6

Generation of 101P3A11 Monoclonal Antibodies (mAbs)

In one embodiment, therapeutic mAbs to 101P3A11 comprise those that react with epitopes of the protein that would disrupt or modulate the biological function of 101P3A11, for example those that would disrupt its interaction with ligands or proteins that mediate or are involved in its biological activity. Therapeutic mAbs also comprise those that specifically bind epitopes of 101P3A11 exposed on the cell surface and thus are useful in targeting mAb-toxin conjugates. Immunogens for generation of such mAbs include those designed to encode or contain the entire 101P3A11 protein or regions of the 101P3A11 protein predicted to be exposed to the extracellular environment and/or antigenic from computer analysis of the amino acid sequence (see, e.g., FIG. 5, FIG. 6, FIG. 7, FIG. 8, or FIG. 9, and the Example entitled "Antigenicity Profiles and Secondary Structure"). Immunogens include peptides, recombinant bacterial proteins, and mammalian expressed Tag 5 proteins and human and murine IgG FC fusion proteins. In addition, cells expressing high levels of 101P3A11, such as 293T-101P3A11 or 300.19-101P3A11 murine Pre-B cells, are used to immunize mice.

To generate mAbs to 101P3A11, mice are first immunized intraperitoneally (IP) with, typically, 10–50 μg of protein immunogen or $10^7$ 101P3A11-expressing cells mixed in complete Freund's adjuvant. Alternatively, mice are immunized intradermally. Mice are then subsequently immunized IP every 2–4 weeks with, typically, 10–50 μg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding 101P3A11 sequence is used to immunize mice by direct injection of the plasmid DNA. For example, the predicted first extracellular loop, amino acids 82–104, or second extracellular loop of 101P3A11, amino acids 159–202, or the third extracellular loop, amino acids 258–275 (in each instance plus or minus 10 amino acids) is cloned into the Tag5 mammalian secretion vector and the recombinant vector is used as immunogen. In another example the same amino acids are cloned into an Fc-fusion secretion vector in which the 101P3A11 sequence is fused at the amino-terminus to an IgK leader sequence and at the carboxyl-terminus to the coding sequence of the human IgG Fc region. This recombinant vector is then used as immunogen. The plasmid immunization protocols are used in combination with purified proteins expressed from the same vector and with cells expressing 101P3A11.

During the immunization protocol, test bleeds are taken 7–10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating 101P3A11 monoclonal antibodies, a Tag5-101P3A11 antigen encoding amino acids 159–202 is expressed and purified from stably transfected 293T cells. Balb C mice are initially immunized intraperitoneally with 25 μg of the Tag5-101P3A11 protein mixed in complete Freund's adjuvant. Mice are subsequently immunized every two weeks with 25 μg of the antigen mixed in incomplete Freund's adjuvant for a total of three immunizations. ELISA using the Tag5 antigen determines the titer of serum from immunized mice. Reactivity and specificity of serum to full length 101P3A11 protein is monitored by Western blotting, immunoprecipitation and flow cytometry using 293T cells transfected with an expression vector encoding the 101P3A11 cDNA (see e.g., the Example entitled "Production of Recombinant 101P3A11 in Eukaryotic Systems"). Other recombinant 101P3A11-expressing cells or cells endogenously expressing 101P3A11 are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescent microscopy, and flow cytometry to identify 101P3A11 specific antibody-producing clones.

The binding affinity of a 101P3A11 monoclonal antibody is determined using standard technologies. Affinity measurements quantify the strength of antibody to epitope binding and are used to help define which 101P3A11 monoclonal antibodies preferred, e.g., for diagnostic or therapeutic use, as appreciated by one of skill in the art. The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

Example 7

HLA Class I and Class II Binding Assays

HLA class I and class II binding assays using purified HLA molecules are performed in accordance with disclosed protocols (e.g., PCT publications WO 94/20127 and WO 94/03205; Sidney et al., *Current Protocols in Immunology* 18.3.1 (1998); Sidney, et al., *J. Immunol.* 154:247 (1995); Sette, et al., *Mol. Immunol.* 31:813 (1994)). Briefly, purified MHC molecules (5 to 500 nM) are incubated with various unlabeled peptide inhibitors and 1–10 nM $^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10–20% of the total radioactivity. All subsequent inhibition and direct binding assays are performed using these HLA concentrations.

Since under these conditions [label]<[HLA] and $IC_{50} \geq$ [HLA], the measured $IC_{50}$ values are reasonable approximations of the true $K_D$ values. Peptide inhibitors are typically tested at concentrations ranging from 120 μg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides.

Example 8

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-Bearing Epitopes The searches performed to identify the motif-bearing peptide sequences in the Example entitled "Antigenicity Profiles" and Tables V–XVIII or XXVI–XXVIII employ the protein sequence data from the gene product of 101P3A11 set forth in FIGS. 2 and 3.

Computer searches for epitopes bearing HLA Class I or Class II supermotifs or motifs are performed as follows. All translated 101P3A 11 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or $\Delta G$) of peptide-HLA molecule interactions can be approximated as a linear polynomial function of the type:

$$"\Delta G" = a_{1i} \times a_{2i} \times a_{3i} \ldots \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et al., *J. Mol. Biol.* 267:1258–126, 1997; (see also Sidney et al., *Human Immunol.* 45:79–93, 1996; and Southwood et al., *J. Immunol.* 160:3363–3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Complete protein sequences from 101P3A11 are scanned utilizing motif identification software, to identify 8-, 9- 10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-Bearing Epitopes

The 101P3A11 protein sequence scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of $\leq 500$ nM, often $\leq 200$ nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 101P3A11 protein is also analyzed for the presence of 8-, 9- 10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of $\leq 500$ nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-Bearing Epitopes

To further increase population coverage, HLA-A1 and -A24 epitopes can also be incorporated into vaccine compositions. An analysis of the 101P3A11 protein can also be performed to identify HLA-A1 and A24-motif-containing sequences.

High affinity and/or cross-reactive binding epitopes that bear other motif and/or supermotifs are identified using analogous methodology.

Example 9

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The 0.221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating 10×10⁶ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about 200–250×10⁶ PBMC are processed to obtain 24×10⁶ CD8⁺ T-cells (enough for a 48-well plate culture). Briefly, the PBMCs are thawed in RPMI with 30 µg/ml DNAse, washed once with PBS containing 1% human AB serum and resuspended in PBS/1% AB serum at a concentration of 20×10⁶ cells/ml. The magnetic beads are washed 3 times with PBS/AB serum, added to the cells (140 µl beads/20×10⁶ cells) and incubated for 1 hour at 4° C. with continuous mixing. The beads and cells are washed 4× with PBS/AB serum to remove the nonadherent cells and resuspended at 100×10⁶ cells/ml (based on the original cell number) in PBS/AB serum containing 100 µl/ml detacha-bead® reagent and 30 µg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5–7 minutes, washed once with PBS with 1% BSA, counted and pulsed with 40 µg/ml of peptide at a cell concentration of 1–2×10⁶/ml in the presence of 3 µg/ml β₂-microglobulin for 4 hours at 20° C. The DC are then irradiated (4,200 rads), washed 1 time with medium and counted again.

Setting up induction cultures: 0.25 ml cytokine-generated DC (at 1×10⁵ cells/ml) are co-cultured with 0.25 ml of CD8+ T-cells (at 2×10⁶ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at 5×10⁶ cells/ml and irradiated at ~4200 rads. The PBMCs are plated at 2×10⁶ in 0.5 ml complete medium per well and incubated for 2 hours at 37° C. The plates are washed twice with RPMI by tapping the plate gently to remove the nonadherent cells and the adherent cells pulsed with 10 µg/ml of peptide in the presence of 3 µg/ml β₂ microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL-2 is added the next day and again 2–3 days later at 50 IU/ml (Tsai et al., *Critical Reviews in Immunology* 18(1–2):65–75, 1998). Seven days later, the cultures are assayed for CTL activity in a ⁵¹Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by ⁵¹Cr Release.

Seven days after the second restimulation, cytotoxicity is determined in a standard (5 hr) ⁵¹Cr release assay by assaying individual wells at a single E:T. Peptide-pulsed targets are prepared by incubating the cells with 10 µg/ml peptide overnight at 37° C.

Adherent target cells are removed from culture flasks with trypsin-EDTA. Target cells are labeled with 200 µCi of ⁵¹Cr sodium chromate (Dupont, Wilmington, Del.) for 1 hour at 37° C. Labeled target cells are resuspended at 10⁶ per ml and diluted 1:10 with K562 cells at a concentration of 3.3×10⁶/ml (an NK-sensitive erythroblastoma cell line used to reduce non-specific lysis). Target cells (100 µl) and effectors (100 µl) are plated in 96 well round-bottom plates and incubated for 5 hours at 37° C. At that time, 100 µl of supernatant are collected from each well and percent lysis is determined according to the formula:

[(cpm of the test sample−cpm of the spontaneous ⁵¹Cr release sample)/(cpm of the maximal ⁵¹Cr release sample−cpm of the spontaneous ⁵¹Cr release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In situ Measurement of Human IFNγ Production as an Indicator of Peptide-Specific and Endogenous Recognition Immunlon 2 plates are coated with mouse anti-human IFNγ monoclonal antibody (4 µg/ml 0.1M NaHCO₃, pH8.2) overnight at 4° C. The plates are washed with Ca²⁺, Mg²⁺-free PBS/0.05% Tween 20 and blocked with PBS/10% FCS for two hours, after which the CTLs (100 µl/well) and targets (100 µl/well) are added to each well, leaving empty wells for the standards and blanks (which received media only). The target cells, either peptide-pulsed or endogenous targets, are used at a concentration of 1×10⁶ cells/ml. The plates are incubated for 48 hours at 37° C. with 5% CO₂.

Recombinant human IFN-gamma is added to the standard wells starting at 400 pg or 1200 pg/100 microliter/well and the plate incubated for two hours at 37° C. The plates are washed and 100 µl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5–15 minutes. The reaction is stopped with 50 microliter/well 1M H₃PO₄ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, 5×10⁴ CD8+ cells are added to a T25 flask containing the following: 1×10⁶ irradiated (4,200 rad) PBMC (autologous or allogeneic) per ml, 2×10⁵ irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 μM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds $1 \times 10^6$/ml and the cultures are assayed between days 13 and 15 at E:T ratios of 30, 10, 3 and 1:1 in the $^{51}$Cr release assay or at $1 \times 10^6$/ml in the in situ IFNγ assay using the same targets as before the expansion.

Cultures are expanded in the absence of anti-CD3$^+$ as follows. Those cultures that demonstrate specific lytic activity against peptide and endogenous targets are selected and $5 \times 10^4$ CD8$^+$ cells are added to a T25 flask containing the following: $1 \times 10^6$ autologous PBMC per ml which have been peptide-pulsed with 10 μg/ml peptide for two hours at 37° C. and irradiated (4,200 rad); $2 \times 10^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-Bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 101P3A11. Briefly, PBMCs are isolated from patients, restimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified as set forth herein are confirmed in a manner analogous to the confirmation of A2- and A3-supermotif-bearing peptides.

Peptides bearing other supermotifs/motifs, e.g., HLA-A1, HLA-A24 etc. are also confirmed using similar methodology Example 10

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analogued to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supermotif-Bearing Peptides

Analogs of HLA-A3 supermotif-bearing epitopes are generated using strategies similar to those employed in analoging HLA-A2 supermotif-bearing peptides. For example, peptides binding to 3/5 of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol.* 157:3480–3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analogued peptides are additionally tested for the ability to stimulate a recall response using PBMC from patients with 101P3A11-expressing tumors.

Other Analoguing Strategies

Another form of peptide analoguing, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 11

Identification and Confirmation of 101P3A11-Derived Sequences with HLA-DR Binding Motifs Peptide epitopes bearing an HLA class II supermotif or motif are identified and confirmed as outlined below using methodology similar to that described for HLA Class I peptides.

Selection of HLA-DR-Supermotif-Bearing Epitopes.

To identify 101P3A11-derived, HLA class II HTL epitopes, the 101P3A11 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., J. Immunol. 160: 3363–3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The 101P3A11-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 101P3A11-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 101P3A11 antigens are analyzed for sequences carrying one of the two DR3-specific binding motifs reported by Geluk et al. (J. Immunol. 152:5742–5748, 1994). The corresponding peptides are then synthesized and confirmed as having the ability to bind DR3 with an affinity of 1 μM or better, i.e., less than 1 μM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 12

Immunogenicity of 101P3A11-Derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.) in vitro primary induction using normal PBMC or 2.) recall responses from patients who have 101P3A11-expressing tumors.

Example 13

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf=1−(SQRT(1− af)) (see, e.g., Sidney et al., *Human Immunol.* 45:79–93, 1996). To obtain overall phenotypic frequencies, cumulative gene frequencies are calculated, and the cumulative antigen frequencies derived by the use of the inverse formula [af=1−(1−Cgf)$^2$].

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%. An analogous approach can be used to estimate population coverage achieved with combinations of class II motif-bearing epitopes.

Immunogenicity studies in humans (e.g., Bertoni et al., *J. Clin. Invest.* 100:503, 1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Recombinant NIH3T3 cells stably expressing 101P3A11 (3T3/101P3A11-pSRa) were derived and were grown in SCID mice (FIG. 20). Mice were injected subcutaneously with 3T3/101P3A1-pSRa cells. Tumors were allowed to grow, mice were then sacrificed and tumors harvested. RNA was isolated from LAPC-4AD and LAPC-4AI xenografts, 3T3/neo-pSRa and 3T3/101P3A11-pSRa grown in culture, as well as six different tumors derived from 3T3/101P3A11-pSRa (Tumor #1–3). Northern blots with 10 μg of total RNA/lane were probed with 101P3A11 sequence. Results show that 101P3A11 was expressed in all 3T3-101P3A11 tumors that grew following injection into mice.

Example 14

CTL Recognition of Endogenously Processed Antigens after Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with 101P3A11 expression vectors.

The results demonstrate that CTL lines obtained from animals primed with peptide epitope recognize endogenously synthesized 101P3A11 antigen. The choice of transgenic mouse model to be used for such an analysis depends upon the epitope(s) that are being evaluated. In addition to HLA-A*0201/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 15

Activity of CTL-HTL Conjugated Epitopes in Transgenic Mice

This example illustrates the induction of CTLs and HTLs in transgenic mice, by use of a 101P3A11-derived CTL and HTL peptide vaccine compositions. The vaccine composition used herein comprise peptides to be administered to a patient with a 101P3A11-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753–4761, 1997). For example, A$_2$/Kb mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/$K^b$ chimeric gene (e.g., Vitiello et al., *J. Exp. Med.* 173:1007, 1991)

In vitro CTL activation: One week after priming, spleen cells ($30 \times 10^6$ cells/flask) are co-cultured at 37° C. with syngeneic, irradiated (3000 rads), peptide coated lymphoblasts ($10 \times 10^6$ cells/flask) in 10 ml of culture medium/T25 flask. After six days, effector cells are harvested and assayed for cytotoxic activity.

Assay for cytotoxic activity: Target cells (1.0 to $1.5 \times 10^6$) are incubated at 37° C. in the presence of 200 μl of $^{51}$Cr. After 60 minutes, cells are washed three times and resuspended in R10 medium. Peptide is added where required at a concentration of 1 μg/ml. For the assay, $10^4$ $^{51}$Cr-labeled target cells are added to different concentrations of effector cells (final volume of 200 μl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a six hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E): target (T) ratio of 50:1 (i.e., $5 \times 10^5$ effector cells for 10,000 targets) in the absence of peptide and 5:1 (i.e., $5 \times 10^4$ effector cells for 10,000 targets) in the presence of peptide, the specific lytic units would be: $[(1/50,000)-(1/500,000)] \times 10^6 = 18$ LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of Immunogenicity". Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 16

Selection of CTL and HTL Epitopes for Inclusion in an 101P3A11-Specific Vaccine.

This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with 101P3A11 clearance. The number of epitopes used depends on observations of patients who spontaneously clear 101P3A11. For example, if it has been observed that patients who spontaneously clear 101P3A11 generate an immune response to at least three (3) from 101P3A11 antigen, then three or four (34) epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site, at URL bimas.dcrt.nih./gov/.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 101P3A11, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 101P3A11.

Example 17

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 101P3A11, are selected such that multiple supermotifs/motifs are represented to ensure broad population coverage. Similarly, HLA class II epitopes are selected from 101P3A11 to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 µg of each of two oligonucleotides are annealed and extended: In an example using eight oligonucleotides, i.e., four pairs of primers, oligonucleotides 1+2, 3+4, 5+6, and 7+8 are combined in 100 µl reactions containing Pfu polymerase buffer (1×=10 mM KCL, 10 mM (NH4)$_2$SO$_4$, 20 mM Tris-chloride, pH 8.75, 2 mM MgSO$_4$, 0.1% Triton X-100, 100 µg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 18

The Plasmid Construct and the Degree to which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683–692, 1996; Demotz et al., *Nature* 342:682–684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567–576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751–761, 1994.

For example, to confirm the capacity of a DNA minigene construct containing at least one HLA-A2 supermotif peptide to induce CTLs in vivo, HLA-A2.1/K$^b$ transgenic mice, for example, are immunized intramuscularly with 100 µg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}$Cr release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-A$^b$-restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. Immunity 1:751–761, 1994). The results indicate the magnitude of the HTL response, thus demonstrating the in vivo immunogenicity of the mini gene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299–S309, 1998) or recombinant vaccinia, for example, expressing a minigene or DNA encoding the complete protein of interest (see, e.g., Hanke et al., *Vaccine* 16:439–445, 1998; Sedegah et al., *Proc. Natl. Acad. Sci USA* 95:7648–53, 1998; Hanke and McMichael, *Immunol. Letters* 66:177–181, 1999; and Robinson et al., *Nature Med.* 5:526–34, 1999).

For example, the efficacy of the DNA minigene used in a prime boost protocol is initially evaluated in transgenic mice. In this example, A2.1/K$^b$ transgenic mice are immunized IM with 100 μg of a DNA minigene encoding the immunogenic peptides including at least one HLA-A2 supermotif-bearing peptide. After an incubation period (ranging from 3–9 weeks), the mice are boosted IP with 10$^7$ pfu/mouse of a recombinant vaccinia virus expressing the same sequence encoded by the DNA minigene. Control mice are immunized with 100 μg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 19

Peptide Composition for Prophylactic Uses

Vaccine compositions of the present invention can be used to prevent 101P3A11 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 101P3A11-associated tumor.

For example, a peptide-based composition is provided as a single polypeptide that encompasses multiple epitopes. The vaccine is typically administered in a physiological solution that comprises an adjuvant, such as Incomplete Freund's Adjuvant. The dose of peptide for the initial immunization is from about 1 to about 50,000 μg, generally 100–5,000 μg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 101P3A11-associated disease.

Alternatively, a composition typically comprising transfecting agents is used for the administration of a nucleic acid-based vaccine in accordance with methodologies known in the art and disclosed herein.

Example 20

Polyepitopic Vaccine Compositions Derived from Native 101P3A11 Sequences

A native 101P3A11 polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes is selected; it can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from 101P3A11 antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (excluding an analoged embodiment) directs the immune response to multiple peptide sequences that are actually present in native 101P3A11, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 21

Polyepitopic Vaccine Compositions from Multiple Antigens

The 101P3A11 peptide epitopes of the present invention are used in conjunction with epitopes from other target tumor-associated antigens, to create a vaccine composition that is useful for the prevention or treatment of cancer that expresses 101P3A11 and such other antigens. For example, a vaccine composition can be provided as a single polypeptide that incorporates multiple epitopes from 101P3A11 as well as tumor-associated antigens that are often expressed with a target cancer associated with 101P3A11 expression, or can be administered as a composition comprising a cocktail of one or more discrete epitopes. Alternatively, the vaccine can be administered as a minigene construct or as dendritic cells which have been loaded with the peptide epitopes in vitro.

Example 22

Use of Peptides to Evaluate an Immune Response

Peptides of the invention may be used to analyze an immune response for the presence of specific antibodies, CTL or HTL directed to 101P3A11. Such an analysis can be performed in a manner described by Ogg et al., Science 279:2103–2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, 101P3A11 HLA-A*0201-specific CTL frequencies from HLA A*0201-positive individuals at different stages of disease or following immunization comprising an 101P3A11 peptide containing an A*0201 motif. Tetrameric complexes are synthesized as described (Musey et al., N. Engl. J. Med. 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 µl of cold phosphate-buffered saline. Tri-color analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 101P3A11 epitope, and thus the status of exposure to 101P3A11, or exposure to a vaccine that elicits a protective or therapeutic response.

Example 23

Use of Peptide Epitopes to Evaluate Recall Responses

The peptide epitopes of the invention are used as reagents to evaluate T cell responses, such as acute or recall responses, in patients. Such an analysis may be performed on patients who have recovered from 101P3A11-associated disease or who have been vaccinated with an 101P3A11 vaccine.

For example, the class I restricted CTL response of persons who have been vaccinated may be analyzed. The vaccine may be any 101P3A11 vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 µg/ml), and Hepes (10 mM) containing 10% heat-inactivated human AB serum (complete RPMI) and plated using microculture formats. A synthetic peptide comprising an epitope of the invention is added at 10 µg/ml to each well and HBV core 128–140 epitope is added at 1 µg/ml to each well as a source of T cell help during the first week of stimulation.

In the microculture format, $4 \times 10^5$ PBMC are stimulated with peptide in 8 replicate cultures in 96-well round bottom plate in 100 µl/well of complete RPMI. On days 3 and 10, 100 µl of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with non-diseased control subjects as previously described (Rehermann, et al., Nature Med. 2:1104,1108, 1996; Rehermann et al., J. Clin. Invest. 97:1655–1665, 1996; and Rehermann et al. J. Clin. Invest. 98:1432–1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670–2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 μM, and labeled with 100 μCr of $^{51}$Cr (Amersham Corp., Arlington Heights, Ill.) for 1 hour after which they are washed four times with HBSS.

Cytolytic activity is determined in a standard 4-h, split well $^{51}$Cr release assay using U-bottomed 96 well plates containing 3,000 targets/well. Stimulated PBMC are tested at effector/target (E/T) ratios of 20–50:1 on day 14. Percent cytotoxicity is determined from the formula: 100×[(experimental release-spontaneous release)/maximum release-spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 101P3A11 or an 101P3A11 vaccine.

Similarly, Class II restricted HTL responses may also be analyzed. Purified PBMC are cultured in a 96-well flat bottom plate at a density of 1.5×10$^5$ cells/well and are stimulated with 10 μg/ml synthetic peptide of the invention, whole 101P3A11 antigen, or PHA. Cells are routinely plated in replicates of 4–6 wells for each condition. After seven days of culture, the medium is removed and replaced with fresh medium containing 10 U/ml IL-2. Two days later, 1 μCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 24

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 μg of peptide composition;

Group II: 3 subjects are injected with placebo and 6 subjects are injected with 50 μg peptide composition;

Group III: 3 subjects are injected with placebo and 6 subjects are injected with 500 μg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 25

Phase II Trials in Patients Expressing 101P3A11

Phase II trials are performed to study the effect of administering the CTL-HTL peptide compositions to patients having cancer that expresses 101P3A11. The main objectives of the trial are to determine an effective dose and regimen for inducing CTLs in cancer patients that express 101P3A11, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21–65 and represent diverse ethnic backgrounds. All of them have a tumor that expresses 101P3A11.

Clinical manifestations or antigen-specific T-cell responses are monitored to assess the effects of administering the peptide compositions. The vaccine composition is found to be both safe and efficacious in the treatment of 101P3A11-associated disease.

Example 26

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of 'Minigene' Multi- Epitope DNA Plasmids" in the form of naked nucleic acid administered IM (or SC or ID) in the amounts of 0.5–5 mg at multiple sites. The nucleic acid (0.1 to 1000 μg) can also be administered using a gene gun. Following an incubation period of 3–4 weeks, a booster dose is then administered. The booster can be recombinant fowlpox virus administered at a dose of 5–$10^7$ to 5×$10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 101P3A11 is generated.

Example 27

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the 101P3A11 protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although 2–50×$10^6$ DC per patient are typically administered, larger number of DC, such as $10^7$ or $10^8$ can also be provided. Such cell populations typically contain between 50–90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive 5×$10^6$ DC, then the patient will be injected with a total of 2.5×$10^8$ peptide-loaded PBMC. The percent DC mobilized by an agent such as Progenipoietin™ is typically estimated to be between 2–10%, but can vary as appreciated by one of skill in the art.

Ex Vivo Activation of CTL/HTL Responses

Alternatively, ex vivo CTL or HTL responses to 101P3A11 antigens can be induced by incubating, in tissue culture, the patient's, or genetically compatible, CTL or HTL precursor cells together with a source of APC, such as DC, and immunogenic peptides. After an appropriate incubation time (typically about 7–28 days), in which the precursor cells are activated and expanded into effector cells, the cells are infused into the patient, where they will destroy (CTL) or facilitate destruction (HTL) of their specific target cells, i.e., tumor cells.

Example 28

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 101P3A11. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 101P3A11 to isolate peptides corresponding to 101P3A11 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 29

Complementary Polynucleotides

Sequences complementary to the 101P3A11-encoding sequences, or any parts thereof, are used to detect, decrease, or inhibit expression of naturally occurring 101P3A11. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 101P3A11. To inhibit transcription, a complementary oligonucleotide is designed from the most unique 5' sequence and used to prevent promoter binding to the coding sequence. To inhibit translation, a complementary oligonucleotide is designed to prevent ribosomal binding to the 101P3A11-encoding transcript.

Example 30

Purification of Naturally-Occurring or Recombinant 101P3A11 Using 101P3A11 Specific Antibodies Naturally occurring or recombinant 101P3A11 is substantially purified by immunoaffinity chromatography using antibodies specific for 101P3A11. An immunoaffinity column is constructed by covalently coupling anti-101P3A11 antibody to an activated chromatographic resin, such as CrBr-activated SEPHAROSE (Amersham Pharmacia Biotech). After the coupling, the resin is blocked and washed according to the manufacturer's instructions.

Media containing 101P3A11 are passed over the immunoaffinity column, and the column is washed under conditions that allow the preferential absorbance of 101P3A11 (e.g., high ionic strength buffers in the presence of detergent). The column is eluted under conditions that disrupt antibody/101P3A11 binding (e.g., a buffer of pH 2 to pH 3, or a high concentration of a chaotrope, such as urea or thiocyanate ion), and GCR.P is collected.

Example 31

Identification of Molecules which Interact with 101P3A11

101P3A11, or biologically active fragments thereof, are labeled with 1211 Bolton-Hunter reagent. (See, e.g., Bolton et al. (1973) Biochem. J. 133:529.) Candidate molecules previously arrayed in the wells of a multi-well plate are incubated with the labeled 101P3A11, washed, and any wells with labeled 101P3A11 complex are assayed. Data obtained using different concentrations of 101P3A11 are used to calculate values for the number, affinity, and association of 101P3A11 with the candidate molecules.

Example 32

In Vivo Assay for 101P3A11 Tumor Growth Promotion

The effect of the 101P3A11 protein on tumor cell growth can be confirmed in vivo by gene overexpression in a variety of cancer cells, including prostate, kidney, colon and bladder. For example, SCID mice can be injected SQ on each flank with $1 \times 10^6$ prostate, kidney, colon or bladder cancer cells (such as PC3, LNCaP, SCaBER, UM-UC-3, HT1376, SK-CO, Caco, RT4, T24, Caki, A-498 and SW839 cells) containing tkNeo empty vector or 101P3A11.

At least two strategies can be used:

(1) Constitutive 101P3A11 expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems.

Figure 42:
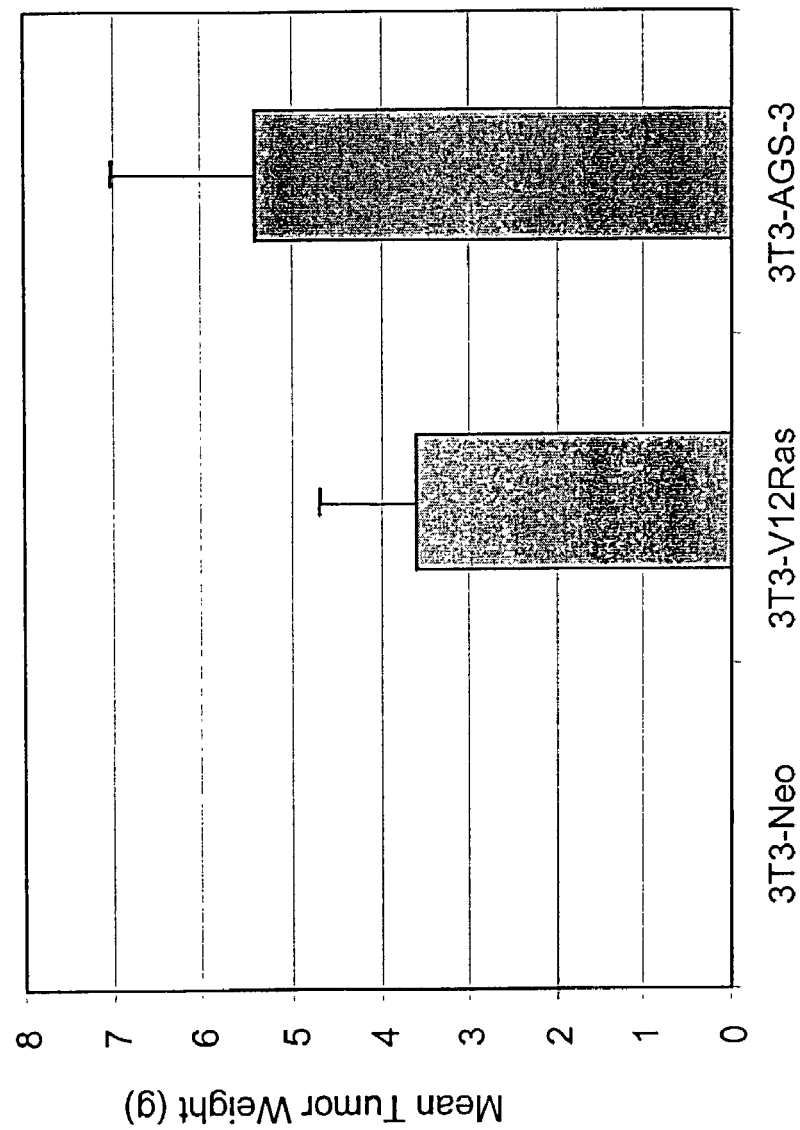
FIG. 42 shows demonstrates that 101P3A11 induces orthotopic growth of tumors. $5 \times 10^5$ cells were injected orthotopically into SCID mice, 7 mice per group; tumor weight was evaluated 24–25 days post cell injection.

(2) Regulated expression under control of an inducible vector system, such as ecdysone, tet, etc., can be used provided such promoters are compatible with the host cell systems. Tumor volume is then monitored at the appearance of palpable tumors and is followed over time to validate that 101P3A11-expressing cells grow at a faster rate and that tumors produced by 101P3A11-expressing cells demonstrate characteristics of altered aggressiveness (e.g., enhanced metastasis, vascularization, reduced responsiveness to chemotherapeutic drugs). FIG. 21 compares subcutaneous growth of control 3T3-neo and 3T3-101P3A11 cells. One million cells stably expressing neo or 101P3A11 were injected subcutaneously in SCID mice along with matrigel. Tumor volume was evaluated by caliper measurements. This experiment demonstrates that expression of 101P3A11 in NIH 3T3 cells is induces tumor formation in 6/6 mice. FIG. 42 shows demonstrates that 101P3A11 induces orthotopic growth of tumors. The results indicated that expression of 101P3A11 is sufficient to induce tumor formation in vivo. Additionally, were implanted with the same cells orthotopically in the prostate to determine if 101P3A11 has an effect on local growth in the prostate or on the ability of the cells to metastasize, specifically to lungs or lymph nodes. In an analogous manner, cells cab be implanted orthotopically in, bladder, colon or kidney. (Saffran, D., et al., PNAS 10: 1073–1078; Fu, X., et al., Int. J. Cancer, 1991. 49: p. 938–939; Chang, S., et al., Anticancer Res., 1997. 17: p. 3239–3242; Peralta, E. A., et al., J. Urol., 1999. 162: p. 1806–1811).

Furthermore, this assay is useful to confirm the 101P3A11 inhibitory effect of candidate therapeutic compositions, such as for example, 101P3A11 antibodies or intrabodies, and 101P3A11 antisense molecules or ribozymes, or 101P3A11 directed small molecules. In FIG. 22, we depict the effect of a small molecule, pertussis toxin (PTX) on tumor formation by 3T3-101P3A11 cells. In this experiment, SCID mice were injected with 3T3-101P3A11 alone or in conjunction with PTX. Each mouse was given 5 doses of PTX at 3–4 days interval. Tumor volume was evaluated by caliper measurements. FIG. 22 shows that PTX inhibits tumor growth in a dose dependent manner. In addition to demonstrating that 101A3P 11 plays an important role in tumor growth, Figures 21 and 22 identify a signaling pathway associated with 101P3A11 and indicate that 101P3A11 produced its effect on tumor growth by activating an adenylate cyclase dependent pathway.

Example 33

110P3A11 Monoclonal Antibody-Mediated Inhibition of Tumors In Vivo

The significant expression of 101P3A11 in cancer tissues, together with its restricted expression in normal tissues, makes 101P3A11 an excellent target for antibody therapy. In cases where the monoclonal antibody target is a cell surface protein, as is 101P3A11, antibodies have been shown to be efficacious at inhibiting tumor growth (See, e.g., Saffran, D., et al., PNAS 10:1073–1078 or www.pnas.org/cgi/doi/10.1073/pnas.051624698). In cases where the target is not on the cell surface, such as PSA and PAP in prostate cancer, antibodies have also been shown to recognize and inhibit growth of cells expressing those proteins (Saffran, D. C., et al., Cancer and Metastasis Reviews, 1999. 18: 437–449). As with any cellular protein with a restricted expression profile, 101P3A11 is a target for T cell-based immunotherapy.

Accordingly, the therapeutic efficacy of anti-101P3A11 mAbs in human colon, kidney, bladder and prostate cancer mouse models is modeled in 101P3A11-expressing kidney, colon, bladder or prostate cancer xenografts or cancer cell lines, such as those described in the Example entitled "In Vivo Assay for 101P3A11 Tumor Growth Promotion", that have been engineered to express 101P3A11.

Antibody efficacy on tumor growth and metastasis formation is confirmed, e.g., in a mouse orthotopic prostate, colon, bladder or kidney cancer xenograft model. The antibodies can be unconjugated, or can be conjugated to a therapeutic modality, as appreciated in the art. It is confirmed that anti-101P3A11 mAbs inhibit formation of 101P3A11-expressing kidney, colon, bladder and prostate tumors. Anti-101P3A11 mAbs also retard the growth of established orthotopic tumors and prolong survival of tumor-bearing mice. These results indicate the utility of anti-101P3A11 mAbs in the treatment of local and advanced stages of cancer. (See, e.g., Saffran, D., et al., PNAS 10:1073–1078 or www.pnas.org/cgi/doi/10.1073/pnas.051624698)

Administration of anti-101P3A11 mAbs retard established orthotopic tumor growth and inhibit metastasis to distant sites, resulting in a significant prolongation in the survival of tumor-bearing mice. These studies indicate that 101P3A11 is an attractive target for immunotherapy and demonstrate the therapeutic potential of anti-101P3A11 mAbs for the treatment of local and metastatic kidney, colon, bladder and prostate cancer. Similar studies manifest that 101P3A11 is safe and effective when used in combination with other therapeutic modalities such as surgery, radiation therapy, hormone therapy or chemotherapy.

This example demonstrates that unconjugated 101P3A11 monoclonal antibodies effectively to inhibit the growth of human bladder tumors grown in SCID mice; accordingly a combination of such efficacious monoclonal antibodies is also effective.

Example 34

Induction Of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 μg of peptide composition;

Group II: 3 subjects are injected with placebo and 6 subjects are injected with 50 μg peptide composition;

Group III: 3 subjects are injected with placebo and 6 subjects are injected with 500 μg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 35

Splice Variants of 101P3A11

Splice variants are also called alternative transcripts. When a gene is transcribed from genomic DNA, the initial RNA is generally spliced to produce functional mRNA, which has only exons and is used for translation into an amino acid sequence. Accordingly, a given gene can have zero to many alternatively spliced mRNA products. Alternative transcripts each have a unique exon makeup, and can have different coding and/or non-coding (5' or 3' end) portions, from the original transcript. Alternative transcripts can code for similar proteins with the same or a similar function or may encode proteins with different functions, and may be expressed in the same tissue at the same time, or at different tissue at different times, proteins encoded by alternative transcripts can have similar or different cellular or extracellular localizations, e.g., be secreted.

Splice variants are identified by a variety of art-accepted methods. For example, splice variants are identified by use of EST data. First, all human ESTs were grouped into clusters which show direct or indirect identity with each other. Second, ESTs in the same cluster were further grouped into sub-clusters and assembled into a consensus sequence. The starting gene is compared to the consensus sequence(s). Each consensus sequence is a potential splice variant for that gene (see, e.g., http://www.doubletwist.com/products/c11_agentsOverview.jhtml). Even when a variant is identified that is not a full-length clone, that portion of the variant is very useful for antigen generation and for further cloning of the full-length splice variant, using techniques known in the art.

Moreover, computer programs are available in the art that identify splice variants based on genomic sequences. Genomic-based variant identification programs include FgenesH (A. Salamov and V. Solovyev, "Ab initio gene finding in *Drosophila* genomic DNA," Genome Research. 2000 April; 10(4):516–22); Grail (http://compbio.ornl.gov/Grail-bin/EmptyGrailForm) and GenScan (http://genes.mit.edu/GENSCAN.html). For a general discussion of splice variant identification protocols see., e.g., Southan, C., "A genomic perspective on human proteases," FEBS Lett. 2001 Jun. 8;498(2–3):214–8; de Souza, S J, et al., "Identification of human chromosome 22 transcribed sequences with ORF expressed sequence tags," Proc. Natl. Acad Sci USA. 2000 Nov. 7; 97(23):12690–3.

For variants identified by the EST-based method, Table XXI shows the nucleotide sequences of the splice variants. Table XXII shows the alignment of the splice variant with the 101P3A11 nucleic acid sequence. Table XXIII displays the single longest alignment of an amino acid sequence encoded by a splice variant, out of all six potential reading frames with 101P3A11. Thus, for each splice variant, a variant's reading frame that encodes the longest single contiguous peptide homology between 101P3A11 and the variant is the proper reading frame orientation for the variant. Due to the possibility of sequencing errors in EST or genomic data, other peptides in the relevant reading frame orientation (5' to 3' or 3' to 5') can also be encoded by the variant. Table XXIV lays out all three frame shifted amino acid translations of the splice variant for the identified reading frame orientation. Tables XXI through XXIV are set forth herein on a variant-by-variant basis.

For variants identified by any one of the genomic sequence-based methods, Table XXI shows the nucleotide sequences of the splice variant. Table XXII shows the alignment of the splice variant with the 101P3A11 nucleic acid sequence. Table XXIII displays the alignment of amino acid sequence of the predicted transcript(s) with 101P3A11. The genomic-based computer programs predict a transcript from genomic sequence, and not only predict exons but also set open reading frame as the first forward open reading frame. The predicted transcript does not contain 5' or 3' untranslated region (UTR). It starts with ATG and ends with a stop codon, TAG, TGA or TAA. In case the transcript is predicted on the reverse strand of the genomic sequence, the sequence of the transcript is reverse-complemented to the genomic sequence of the exons. Thus, the genomic-based programs provide the correct transcript sequence, with 5' to 3' orientation and +1 as the open reading frame. However, due to the possibility of inaccurate prediction of exons or the possibility of sequencing errors in genomic data, other peptides in other forward open reading frames can also be encoded by the variant. Table XXIV lays out all amino acid translations of the splice variant in each of the three forward reading frames. Tables XXI through XXIV are set forth herein on a variant-by-variant basis.

To further confirm the parameters of a splice variant, a variety of techniques available in the art are used, such as full-length cloning, proteomic validation, PCR-based validation, and 5' RACE validation, etc. (see e.g., Proteomic Validation: Brennan S O, Fellowes A P, George P M.; "Albumin banks peninsula: a new termination variant characterized by electrospray mass spectrometry." Biochim Biophys Acta. 1999 Aug. 17; 1433(1–2):321–6; Ferranti P, et al., "Differential splicing of pre-messenger RNA produces multiple forms of mature caprine alpha(s1)-casein." Eur J. Biochem. 1997 Oct. 1; 249(1):1–7; PCR-based Validation: Wellmann S, et al., "Specific reverse transcription-PCR quantification of vascular endothelial growth factor (VEGF) splice variants by LightCycler technology." Clin Chem. 2001 April; 47(4):654–60; Jia H P, et al., "Discovery of new human beta-defensins using a genomics-based approach," Gene. 2001 Jan. 24; 263(1–2):211–8; PCR-based and 5' RACE Validation: Brigle I. E., et al., "Organization of the murine reduced folate carrier gene and identification of variant splice forms," Biochim Biophys Acta. 1997 Aug. 7; 1353(2): 191–8.

It is known in the art that genomic regions are modulated in cancers. When the genomic region to which 101P3A11 maps is modulated in a particular cancer, the splice variants of 101P3A11 are modulated as well. Disclosed herein is that 101P3A11 has a particular expression profile. Splice variants of 101P3A11 that are structurally and/or functionally similar to 101P3A11 share this expression pattern, thus serving as tumor-associated markers/antigens.

Using the EST assembly approach, we identified one splice variant.

Example 36

Splice Variant Protein Characteristics

The present variant protein set forth in Table XXI is understood to be partial, and thus to comprise domains of the full protein. Nucleotides 1–217 of variant align with nucleotides 66–290 of 101P3A11. Similarly, amino acids 3–155 of the 101P3A11 variant protein align with amino acids 70–222 of 101P3A11 with 100% identity, while the remaining downstream amino acids diverge from the 101P3A11. This pattern of high homology to one section of the parent protein coupled to a high divergence from the remaining portions of the parent protein form the hallmark of a splice variant.

Protein blast analysis of 101P3A11 variant shows that the 101P3A11 variant is homologous to the human olfactory receptor 52D1 (gi 14423837) with 35% identify over 68 amino acids located towards the amino terminal of 101P3A11 variant 1. 101P3A11 variant 1 shows homology to rat olfactory receptor RA1c (gi 3420759) with 53% identity over 32 amino acids. Analysis by pFam or Prosite did not identify any motifs.

Based on TMPred bioinformatic analysis the 101P3A11 variant appears to contain one transmembrane domain. In contrast, Sosui predicts no transmembrane domain but suggests that 101P3A11 variant 1 forms a soluble intracellular protein. Due to its homology to 101P3A11 and olfactory receptors, the 101P3A11 variant 1 is associated with cancer and signaling.

Example 37

Identification of 101P3A11 Sequences Involved in Ligand Binding

As shown in FIG. 4, the transmembrane regions of 101P3A11 and mouse olfactory receptor S25 (ORS25) predicted using the TMHMM algorithm are highlighted in gray. The amino acids of ORS25 predicted by Floriano, et al. to be involved in binding of the ligand hexanol and/or involved in the formation of the ligand binding pocket are italicized and bolded in FIG. 4, and are listed below. (Floriano, W. B., et al, 2000, Proc. Natl. Acad. Sci., USA, 97:10712–10716)

| Leu | 131 |
|-----|-----|
| Val | 134 |
| Val | 135 |
| Gly | 138 |
| Thr | 139 |
| Ser | 193 |
| Ser | 197, |
| Phe | 225 |
| Ala | 230 |
| Ile | 231 |
| Gly | 234 |
| Thr | 284 |
| Phe | 287 |
| Gln | 300 |
| Lys | 302 |

Sequences of 101P3A11 involved in ligand binding are identified based on homology to mouse olfactory receptor S25. Shown is the amino acid alignment of 101P3A11 with mouse olfactory receptor S25 depicting the predicted transmembrane domains of each GPCR. The amino acids of S25 involved in the recognition and binding of its ligand hexanol or that lie in the proximity of the binding pocket (Floriano, W. B., et al, 2000, Proc. Natl. Acad. Sci., USA, 97:10712–10716), are also shown. These amino acids lie close to or within the transmembrane domains of ORS25. Accordingly, the structurally homologous regions of 101P3A11 are involved in the binding of its cognate ligand. These regions encode the amino acids of the first extracellular loop and of the amino terminal end of transmembrane domain 3 (amino acids 82–112), the amino acids at the carboxyl terminal end of transmembrane domain 4 and into the second extracellular loop (amino acids 160–185), the amino acids at the end of the second extracellular loop and into transmembrane domain 5 (amino acids 186–212), and the amino acids at the carboxyl terminal end of transmembrane domain 6, the third extracellular loop, and the amino terminal end of transmembrane domain 7 (amino acids 250–280). Thus, ligands of 101P3A11 are identified that interact with at least 3 of the following regions of 101P3A11: amino acids 82–112, amino acids 160–185, amino acids 186–212, and, amino acids 250–280.

Example 38

Homology Comparison of 101P3A11 to Known Sequences

The 101P3A11 protein of FIG. 3 has 317 amino acids with calculated molecular weight of 35.2 kDa, and pI of 8.7. 101P3A11 is predicted to be a cell surface protein. Cellular localization was demonstrated by FACS analysis and immunofluorescence in cells engineered to express 101P3A11.

101P3A11 shows best homology to rat olfactory receptor RA1c (gi 3420759, http://www.ncbi.nlm.nih.gov) sharing 59% identity and 76% homology with that protein. 101P3A11 also shows homology to human prostate specific GPCR (gi 13540539) and human olfactory receptor 51112 (gi 14423836), sharing 59% identities/77% homology, and 53% identities/69% homology with each, respectively (FIGS. 23–25).

Sequence and motif analysis indicate that 101P3A11 belongs to the family of olfactory receptors. Bioinformatic analysis revealed 101P3A11 to be a 7 transmembrane protein, with strong domain and structural homology to G-protein coupled receptors (GPCRs) (see Table XXV, TM Pred, Sosui, Pfam, Blocks, Print). Proteins that are members of the G-protein coupled receptor family exhibit an extracellular amino-terminus, three extracellular loops, three intracellular loops and an intracellular carboxyl terminus. G-protein coupled receptors are seven-transmembrane receptors that are stimulated by polypeptide hormones, neurotransmitters, chemokines and phospholipids (Civelli O et al, Trends Neurosci. 2001, 24:230; Vrec1 M et al Mol Endocrinol. 1998, 12:1818). Ligand binding traditionally occurs between the first and second extracellular loops of the GPCR. Upon ligand binding GPCRs transduce signals across the cell surface membrane by associating with trimeric G proteins. Their signals are transmitted via trimeric guanine-nucleotide binding proteins (G proteins) to effector enzymes or ion channels (Simon et al., 1991, Science 252: 802). Signal transduction and biological output mediated by GPCR can be modulated through various mechanisms including peptide mimics, small molecule inhibitors and GPCR kinases or GRK (Pitcher J A et al, J. Biol. Chem. 1999, 3; 274:34531; Fawzi AB, et al. 2001, Mol. Pharmacol., 59:30).

Recently, GPCRs have also been shown to link to mitogenic signaling pathways of tyrosine kinases (Luttrell et al., 1999, Science 283: 655; Luttrell et al., 1999 Curr Opin Cell Biol 11: 177). GPCRs are regulated by phosphorylation mediated by GPCR kinases (GRKs), which themselves are indirectly activated by the GPCRs (Pitcher et al., 1998, Ann. Rev. Biochem. 67: 653). Olfactory GPCRs transmit their signals by activating the cAMP pathway via adenylate cyclase resulting in downstream signaling to protein kinase A, and by activating the phospholipase C pathway by generating inositol 1,4,5-trisphosphate (IP3) and diacylglycerol (DAG) (Breer, 1993, Ciba Found Symp 179: 97; Bruch, 1996, Comp Biochem Physiol B Biochem Mol Biol 113:451). IP3 results in an increase in intracellular calcium, while DAG activates protein kinase C.

Recent studies have associated GPCRs with cellular transformation. In particular, KSHV G protein-coupled receptor was found to transform NIH 3T3 cells in vitro and induces multifocal KS-like lesions in KSHV-GPCR-transgenic mice (Schwarz M, Murphy P M. J Immunol 2001, 167:505). KSHV-GPCR was capable of producing its effect on endothelial cells and fibroblasts by activating defined signaling pathways, including the AKT survival pathway (Montaner S et al, Cancer Res 2001, 61:2641). In addition, KSHV-GPCR induced the activation of mitogenic pathways such as AP-1 and NFkB, resulting in the expression of pro-inflammatory genes (Schwarz M, Murphy P M. J Immunol 2001, 167: 505). Other GPCR associated with tumor formation include G2A, and the PAR-1, which has been found to induce transformation of NIH 3T3 cells (Whitehead I et al, Oncogene 2001, 20:1547).

This information indicates that 101P3A11 plays a role in the transformation of mammalian cells, induces mitogenic responses including activation of various signaling pathways, and regulate gene transcription by transmitting cell surface signals to the nucleus, see also, the Example entitled, "In Vivo Assay for 101P3A11 Tumor Growth Promotion".

Accordingly, when 101P3A11 functions as a regulator of cell transformation, tumor formation, or as a modulator of transcription involved in activating genes associated with inflammation, tumorigenesis or proliferation, 101P3A11 is used for therapeutic, diagnostic, prognostic and/or preventative purposes, in manners analogous to or that track other GPCRs as discussed herein and in the art.

Example 39

Identification and Confirmation of Potential Signal Transduction Pathways

Many mammalian proteins have been reported to interact with signaling molecules and to participate in regulating signaling pathways. (J. Neurochem. 2001; 76:217–223). In particular, GPCRs have been reported to activate MAK cascades as well as G proteins, and been associated with the EGFR pathway in epithelial cells (Naor, Z., et al, Trends Endocrinol Metab. 2000, 11:91; Vacca Fetal, Cancer Res. 2000, 60:5310; Della Rocca G. J., et al, J. Biol. Chem. 1999, 274:13978). Using immunoprecipitation and Western blotting techniques, proteins are identified that associate with 101P3A11 and mediate signaling events. Several pathways known to play a role in cancer biology can be regulated by 101P3A11, including phospholipid pathways such as PI3K, AKT, etc, adhesion and migration pathways, including FAK, Rho, Rac-1, etc, as well as mitogenic/survival cascades such as ERK, p38, etc (Cell Growth Differ. 2000, 11:279; J. Biol. Chem. 1999, 274:801; Oncogene. 2000, 19:3003; J. Cell Biol. 1997, 138:913).

Using Western blotting and other techniques, the ability of 101P3A11 to regulate these pathways is confirmed. Cells expressing or lacking 101P3A11 are either left untreated or stimulated with cytokines, androgen and anti-integrin antibodies. Cell lysates were analyzed using anti-phospho-specific antibodies (Cell Signaling, Santa Cruz Biotechnology) in order to detect phosphorylation and regulation of ERK, p38, AKT, PI3K, PLC and other signaling molecules. Using such techniques, we showed that 101P3A11 alters the tyrosine phosphorylation pattern of NIH 3T3 cells (FIG. 26) indicating that 101P3A11 is regulating protein kinases and phosphatases. In the experiment shown in FIG. 26, control 3T3-neo and 3T3-101P3A11 cells were either treated with 0.5 or 10% FBS and whole cell lysates were analyzed by anti-phosphotyrosine Western blotting. Expression of 101P3A11 resulted in reduced phosphorylation of several proteins in NIH-3T3 cells, while inducing the phosphorylation of proteins at 79–81 and 28–32 kDa.

Using anti-Phospho-ERK antibodies, we demonstrated that expression of 101P3A11 induced ERK phosphorylation in the prostate cancer cell line PC3 (FIG. 27A and FIG. 27B), and that ERK phosphorylation in 101P3A11 expressing cells was regulated by GPCR ligands. In this experiment, control PC3-neo cells and PC3-101P3A11 cells were left untreated (0.1% FBS) or were stimulated with 10% FBS, lipophosphatidic acid (LPA), gastrin releasing peptide (GRP), leukotriene (LKB4) or platelet activating factor (PAF). The cells were lysed and analyzed by Western blotting using anti-Phospho-ERK (FIG. 27A) or anti-ERK (FIG. 27B) mAb. The results showed that expression of 101P3A11 mediated significant ERK phosphorylation by FBS, LPA, GRP and PAF, while LKB4 resulted in a more modest level of ERK phosphorylation in PC3-101P3A11 cells. In contrast, none of the GPCR ligands induced significant ERK phosphorylation in PC3-Neo cells, demonstrating the specificity of GPCR ligands-mediated responses in 101P3A11 expressing cells. The ERK overlay demonstrated equal loading, supporting the specificity of this data. In order to delineate the signaling pathway by which 101P3A11 mediates ERK phosphorylation in cancer cells, it was confirmed which of the two pathway inhibitors: MEK inhibitor PD98059 or the p38 inhibitor SB203580 regulate 101P3A11 mediated ERK phosphorylation (FIG. 28). To obtain this data, PC3-neo and PC3-101P3A11 cells were treated with media alone or in the presence of PD98059, SB203580, or genistein were stimulated with FBS or GRP. Cells were lysed and analyzed by Western blotting using anti-Phospho-ERK or anti-ERK mAb. Treatment with 10% FBS or with GRP induced the phosphorylation of ERK in PC3-101P3A11 but not in control PC3-neo cells. 101P3A11-mediated ERK phosphorylation was inhibited by the MEK-1 inhibitor PD98059 but not the p38 inhibitor SB203580 or genistein. The ERK overlay demonstrated equal loading, supporting the specificity of the results. These results were confirmed by those obtained in two additional sets of experiments. The inhibition of 101P3A11-mediated ERK phosphorylation by PD98059 demonstrates that 101P3A11 activated the classical MEK-ERK cascade, a pathway associated with mitogenesis, proliferation and tumorigenesis.

Results in FIGS. 26–28 indicate that 101P3A11 regulates the activity of kinases, including ERK, and phosphatases. In order to confirm the association of 101P3A11 with phosphatase activity, the effect of the protein phosphatase inhibitor sodium orthovanadate on 101P3A11 mediated ERK phosphorylation was determined (FIG. 29). PC3-neo and PC3-101P3A11 cells were grown in media alone or in the presence of sodium orthovanadate (Na3VO4), and were stimulated with 0.1% or 10% FBS. Cells were lysed and analyzed by Western blotting using anti-Phospho-ERK or anti-ERK mAb. Treatment with Na3VO4 resulted in a 4.5-fold increase in ERK phosphorylation in PC3-101P3A11 cells, compared to a two-fold increase in PC3-neo cells. Results in FIG. 29 confirm the contribution of protein phosphatases to 101P3A11 mediated signaling.

Several GPCRs have been shown to transactivate receptor tyrosine kinases associated with the cell membrane, such as the EGF receptor (EGFR) (Pierce K. L., et al, J. Biol. Chem. 2001, 276:23155; Nath, D., et al, J Cell Sci. 2001, 114: 1213). In order to determine whether 101P3A11 signaling results in the activation of EGFR, we compared the effect of the EGFR inhibitor, AG1517, on EGFR- and 101P3A11-mediated ERK phosphorylation (FIG. 30). In FIG. 30, PC3-neo and PC3-101P3A11 cells were grown in media alone (0.1% FBS) or in the presence of AG1517. The cells were stimulated with 0.1% or 10% FBS, GRP or EGF, lysed and analyzed by Western blotting using anti-Phospho-ERK or anti-ERK mAb. Treatment with 10% FBS, GRP and EGF induced ERK phosphorylation in PC3-101P3A11 cells. ERK phosphorylation by EGF was completely inhibited by AG1517. 101P3A11 mediated ERK phosphorylation in cells treated with 10% FBS was partially inhibited by AG1517. Data in FIG. 30 indicate that some cross talk occurred between 101P3A11 and EGFR signaling pathways.

In addition to activating the ERK cascade, 101P3A11 activated a parallel MAK pathway, namely p38. In FIG. 31A and FIG. 31B, PC3-neo and PC3-101P3A11 cells were grown in 1% or 10% FBS. Cells were lysed and analyzed by Western blotting using anti-Phospho-p38 (FIG. 31A) or anti-p38 (FIG. 31B) monoclonal antibody (mAb). Our results demonstrate that expression of 101P3A11 mediated p38 phosphorylation in cells treated with 10% FBS. Equal loading was demonstrated in the p38 overlay.

Results shown in FIGS. 26–30 and FIGS. 31A–31B confirm that 101P3A11 activates several signaling pathways in cancer cells, including the ERK and p38 cascades. In addition to MAPK, 101P3A11 signaling was associated with protein phosphatase activity and EGFR transactivation. These signaling pathways have been associated with cell growth, survival and transcriptional activation, all of which play an important role in tumor initiation and progression. When 101P3A11 plays a role in the regulation of signaling pathways, whether individually or communally, it is used as a target for diagnostic, prognostic, preventative and/or therapeutic purposes.

To confirm that 101P3A11 directly or indirectly activates known signal transduction pathways in cells, luciferase (luc) based transcriptional reporter assays are carried out in cells expressing individual genes. These transcriptional reporters contain consensus-binding sites for known transcription factors that lie downstream of well-characterized signal transduction pathways. The reporters and examples of these associated transcription factors, signal transduction pathways, and activation stimuli are listed below.

1. NFkB-luc, NFkB/Rel; Ik-kinase/SAPK; growth/apoptosis/stress
2. SRE-luc, SRF/TCF/ELK1; MAPK/SAPK; growth/differentiation
3. AP-1-luc, FOS/JUN; MAPK/SAPK/PKC; growth/apoptosis/stress
4. ARE-luc, androgen receptor; steroids/MAPK; growth/differentiation/apoptosis 5. p53-luc, p53; SAPK; growth/differentiation/apoptosis
6. CRE-luc, CREB/ATF2; PKA/p38; growth/apoptosis/stress Gene-mediated effects can be assayed in cells showing mRNA expression. Luciferase reporter plasmids can be introduced by lipid-mediated transfection (TFX-50, Promega). Luciferase activity, an indicator of relative transcriptional activity, is measured by incubation of cell extracts with luciferin substrate and luminescence of the reaction is monitored in a luminometer.

Signaling pathways activated by 101P3A11 are mapped and used for the identification and validation of therapeutic targets. When 101P3A11 is involved in cell signaling, it is used as target for diagnostic, prognostic, preventative and/or therapeutic purposes.

Example 40

101P3A11 Functions as a GPCR

Sequence and homology analysis of 101P3A11 indicated that 101P3A11 is a member of the olfactory receptor family of GPCR. Olfactory receptors are known to regulate biological responses by activating adenylate cyclase. In order to confirm that 101P3A11 functions as a GPCR and mediates the activation of adenylate cyclase, cAMP accumulation in PC3 and PC3-101P3A11 cells were compared (FIG. 32). Control PC3 and PC3-101P3A11 cells were grown in a low concentration of fetal bovine serum (FBS) for 14 hrs in the presence or absence of pertussis toxin (PTX). The cells were stimulated with 0.1% or 10% FBS, washed in PBS and lysed using a lysis buffer provided by Amersham Pharmacia. Intracellular concentration of cAMP was measured using a commercially available enzyme immunoassay (EIA) according to the manufacturer's recommendations (Amersham Pharmacia). Each assay was performed in duplicate. Calculations of cAMP concentrations were based on OD450 of the standard curve. Expression of 101P3A11 induced a four-fold increase in cAMP accumulation in the absence of stimulation. Treatment with 10% FBS further enhanced cAMP accumulation in PC3-101P3A11 cells to nearly seven-fold over control PC3-neo cells. 101P3A11 mediated cAMP accumulation was inhibited by PTX. These results were confirmed by two separate sets of experiments. Results shown in FIG. 32 demonstrate that 101P3A11 functions as a GPCR in prostate cancer cells and exhibits classical GPCR characteristics, such as cAMP accumulation that is inhibited by PTX.

Since adenylate cyclase activity modulates intracellular levels of cAMP and induce downstream signaling events such as activation of protein kinase A, calcium and ERK MAPK signaling (Pierce K. L., et al, Oncogene. 2001, 20:1532), we determined that PTX, an inhibitor of adenylate cyclase signaling, prevents 101P3A11-mediated ERK phosphorylation along with inhibiting cAMP accumulation (FIG. 33 and FIG. 34). PC3-neo and PC3-101P3A11 cells were grown overnight in 0.1% FBS in media alone or in the presence of pertussis toxin (PTX). Cells were stimulated with 0.1% or 10% FBS (FIG. 33) or 10% FBS, EGF or GRP (FIG. 34). Cells were lysed and analyzed by Western blotting using anti-Phospho-ERK mAb. Expression of 101P3A11 mediated ERK phosphorylation by 10% FBS in PC3 cells, which was inhibited by PTX (FIG. 33 and FIG. 34). In contrast, GRP and EGF-mediated ERK phosphorylation was relatively unaffected by PTX (FIG. 34), demonstrating the specificity of 101P3A11 mediated responses. These results were replicated in additional experiments.

GPCR transmit their signal by activating trimeric G proteins. Once GPCRs are activated, the associated Ga subunit binds GTP, dissociates from the receptor and participates in downstream signaling events (Schild, D., and Restrepo, D. Physiol Rev. 1998, 78:429–66). In order to determine that inhibition of Ga subunits has an effect on 101P3A11 mediated cell growth, the effect of two Ga inhibitors on the proliferation of 3T3-101P3A11 cells was investigated. Control 3T3 and 3T3-101P3A11 cells were grown in the presence or absence of suramin or its derivative NF 449 (Sigma). Cells were analyzed for proliferation 72 hours later (FIG. 35). The experiment was performed in triplicate. The data showed that suramin and NF449 inhibited the proliferation of 3T3-101P3A11 cells by 60% and 80%, respectively. This response was 101P3A11 specific as suramin and NF449 had no effect on the proliferation of control 3T3 cells. Thus, as 101P3A11 is involved in GPCR activity, it is used as target for diagnostic, prognostic, preventative and/or therapeutic purposes.

GPCRs can be activated by a variety of ligands, including hormones, neuropeptides, chemokines, odorants and phospholipids. In the case of olfactory receptors, individual olfactory receptors may recognize multiple odorants, and can are activated by a diverse array of molecules. These ligands and molecules recognized by a receptor (as described above) are small molecules as described herein.

In order to identify 101P3A11 (small molecule) ligand(s), the possibility that epithelial cells may be secreting 101P3A11 activators was investigated (FIGS. 36A and 36B). Prostate cancer epithelial cells, (PC3, PC3-101P3A11, LAPC4$^2$hT), normal prostate cells (PrEC), fibroblasts (3T3, 3T3-101P3A11), and human kidney epithelial cells (293T) were grown in the presence or absence of FBS. Cell supernatants were collected and used to stimulate PC3 and PC3-101P3A11 cells. Cell lysates from resting and supernatant treated PC3 and PC3-101P3A11 cells were lysed and analyzed by Western blotting with anti-Phospho-ERK (FIG. 36A) and anti-ERK (FIG. 36B) mAb. As shown in FIG. 36A and FIG. 36B, supernatants form normal prostate cells, PrEC, and prostate cancer cells, PC3, PC3-101P3A11 and LAPC4$^2$hT, induced the phosphorylation of ERK in PC3-101P3A11 but not control PC3 cells. In contrast, no specific ERK phosphorylation was observed using supernatants from 3T3 or 293T cells. Our results show that prostate cells, grown in the absence of serum, produce one or more factors that contribute to the activation of 101P3A11 mediated signaling events. Thus, as 101P3A11 responds to stimuli and functions in signaling and GPCR activity, it is used as target for diagnostic, prognostic, preventative and/or therapeutic purposes.

Example 41

Inhibitors of 101P3A11 GPCR Function

As mentioned in the Example entitled "Homology Comparison of 101P3A11 to Known Sequences," GPCRs are activated by ligand binding to the extracellular loops, resulting in the activation of trimeric G proteins and the initiation of several signaling cascades. Using this information, several therapeutic and small molecule strategies are utilized to inhibit GPCR activation or downstream signaling events.

One strategy inhibits receptor and ligand binding. Recent studies using several types of GPCRs, have demonstrated the effectiveness of this strategy (Fawzi AB, et al. 2001, Mol. Pharmacol., 59:30). Using a compound named SCH-202676, they inhibited agonist and antagonist binding to GPCRs by allosterically hindering ligand-GPCR interaction. Using this and even more specific allosteric (small molecule) inhibitors, signal transduction through 101P3A11 is inhibited, thereby providing therapeutic, prognostic, diagnostic and/or prophylactic benefit.

A second approach is to inhibit G alpha subunit activation. Activation of GPCRs results in the exchange of GTP for GDP on the G alpha subunit of the trimeric G protein. Inhibition of Ga activation prevents the activation of downstream signaling cascades and therefore biological effects of GPCR. One molecule used to inhibit GDP exchange on Ga subunits is Suranim (Freissmuth M et al, 1996, Mol. Pharmacol, 49:602). Since suranim functions as a universal Ga inhibitor, it prevents the activation of most Ga subunits. Using techniques described, for example and without limitation, in the present Examples entitled "In Vivo Assay for 101P3A11 Tumor Growth Promotion;" "Identification and Confirmation of Potential Signal Transduction Pathways," "101P3A11 Functions as a GPCR," and "Regulation of Transcription", small molecules are identified that selectively inhibit the Ga subunit that associates with 101P3A11, thereby providing therapeutic, prognostic, diagnostic and/or prophylactic benefit.

A third approach is to inhibit Ga subunit association with GPCR. In order for trimeric G proteins to be activated following GPCR/ligand interaction, it is necessary for them to associate with their corresponding GPCR. Mutational analysis has mapped the interaction of Ga to the first and third intracellular loops of GPCRs (Heller R at al. 1996, Biochem. Biophys. Res. Commun). Several studies have used synthetic (small molecule) peptides corresponding to the intracellular sequence of loops 1 and 3 as inhibitors (Mukherjee, S., et al. 1999, J. Biol. Chem.). Using such short peptides that serve as receptor mimics, they are used to compete for binding of Ga subunits to 101P3A11 and thereby provide therapeutic, prognostic, diagnostic and/or prophylactic benefit.

Thus, compounds and small molecules designed to inhibit 101P3A11 function and downstream signaling events are used for therapeutic diagnostic, prognostic and/or preventative purposes.

Example 42

Involvement in Tumor Progression

The 101P3A11 gene can contribute to the growth of cancer cells. The role of 101P3A11 in tumor growth is confirmed in a variety of primary and transfected cell lines including prostate, colon, bladder and kidney cell lines, as well as NIH 3T3 cells engineered to stably express 101P3A11. Parental cells lacking 101P3A11 and cells expressing 101P3A11 are evaluated for cell growth using a well-documented proliferation assay (Fraser S P, et al., Prostate 2000; 44:61, Johnson D E, Ochieng J, Evans S L. Anticancer Drugs. 1996, 7:288). Using such a technique, we demonstrated (see FIG. 37) that 101P3A11 imparts a growth advantage on NIH 3T3 cells. 3T3-neo and 3T3-101P3A11 cells were grown in 0.5% or 10% FBS and analyzed 48 hours later. The assay was performed in triplicate. Expression of 101P3A11 resulted in 6-fold increase in proliferation relative to control 3T3 cells grown in 0.5% FBS.

Figure 43:
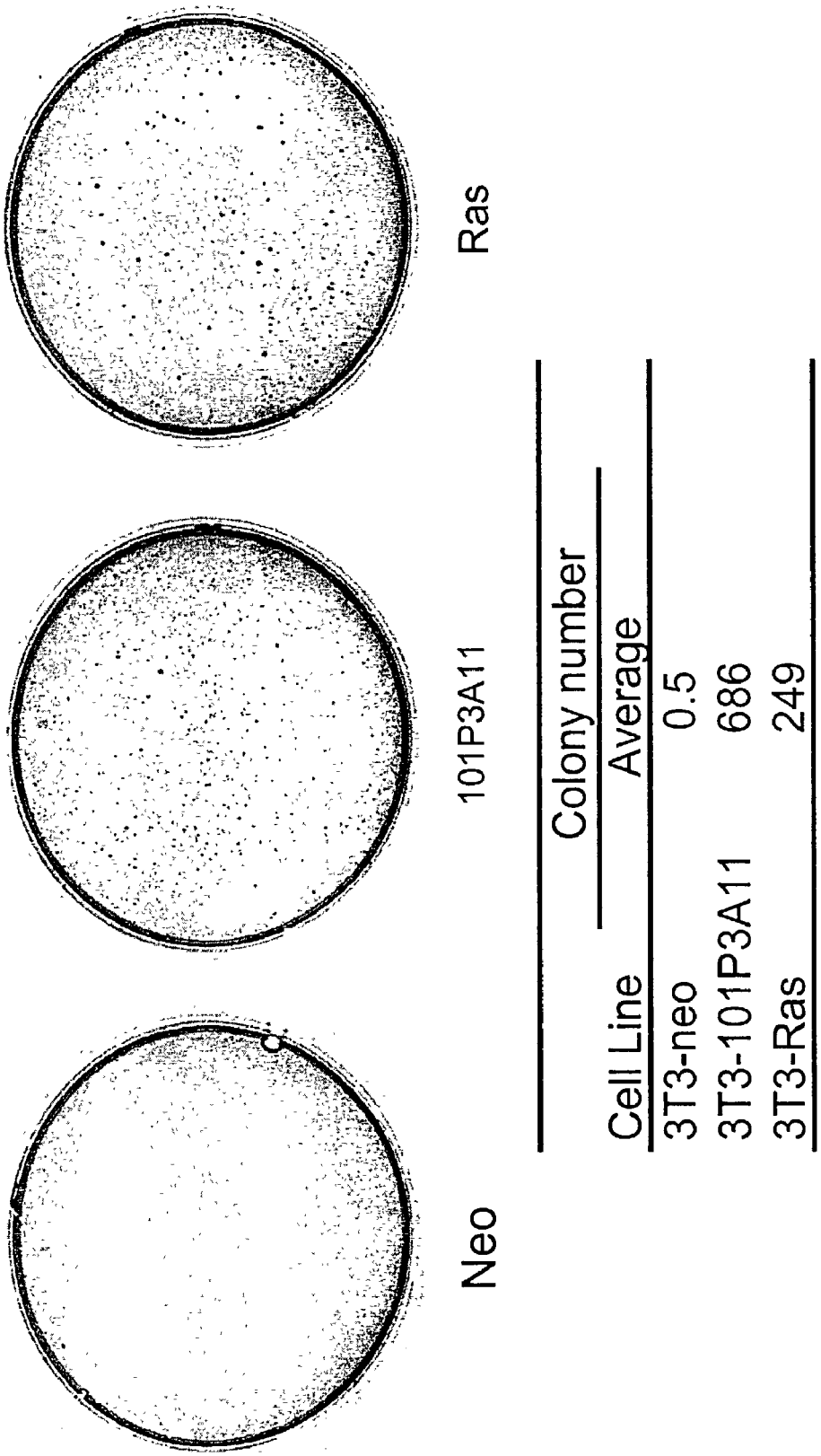
FIG. 43 shows that 101P3A11 induces colony formation in a soft agar assay.

To confirm the role of 101P3A11 in the transformation process, its effect in colony forming assays was investigated. Parental NIH-3T3 cells lacking 101P3A11 were compared to NIH-3T3 cells expressing 101P3A11, using a soft agar assay under stringent and more permissive conditions (Song Z. et al. Cancer Res. 2000; 60:6730). The results are shown in FIG. 43, where 101P3A11 induces colony formation of over 100 fold increase relative to neo resistant controls. We previously showed that expression of 101P3A11 in NIH 3T3 cells induces the growth of these cells in soft agar (129-24usu1), indicating that 101P3A11 participates in the process of transformation.

To confirm the role of 101P3A11 in invasion and metastasis of cancer cells, a well-established assay is used. A non-limiting example is the use of an assay which provides a basement membrane or an analog thereof used to detect whether cells are invasive (e.g., a Transwell Insert System assay (Becton Dickinson) (Cancer Res. 1999; 59:6010)). Control cells, including prostate, colon, bladder and kidney cell lines lacking 101P3A11 are compared to cells expressing 101P3A11. Cells are loaded with the fluorescent dye, calcein, and plated in the top well of a support structure coated with a basement membrane analog (e.g. the Transwell insert) and used in the assay. Invasion is determined by fluorescence of cells in the lower chamber relative to the fluorescence of the entire cell population.

101P3A11 can also play a role in cell cycle and apoptosis. Parental cells and cells expressing 101P3A11 are compared for differences in cell cycle regulation using a well-established BrdU assay (Abdel-Malek Z A. J Cell Physiol. 1988, 136:247). In short, cells are grown under both optimal (full serum) and limiting (low serum) conditions are labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing 101P3A11, including normal and tumor prostate, colon and lung cells. Engineered and parental cells are treated with various chemotherapeutic agents, such as etoposide, flutamide, etc, and protein synthesis inhibitors, such as cycloheximide. Cells are stained with annexin V-FITC and cell death is measured by FACS analysis. The modulation of cell death by 101P3A11 can play a critical role in regulating tumor progression and tumor load.

When 101P3A11 plays a role in cell growth, transformation, invasion or apoptosis, it is used as a target for diagnostic, prognostic, preventative and/or therapeutic purposes.

Example 43

Involvement in Angiogenesis

Angiogenesis or new capillary blood vessel formation is necessary for tumor growth (Hanahan, D.; Folkman, J.; Cell. 1996, 86:353; Folkman J. Endocrinology. 1998 139:441). Several assays have been developed to measure angiogenesis in vitro and in vivo, such as the tissue culture assays endothelial cell tube formation and endothelial cell proliferation. Using these assays as well as in vitro neo-vascularization, the role of 101P3A11 in angiogenesis, enhancement or inhibition, is confirmed.

For example, endothelial cells engineered to express 101P3A11 are evaluated using tube formation and proliferation assays. The effect of 101P3A11 is also confirmed in animal models in vivo. For example, cells either expressing or lacking 101P3A11 are implanted subcutaneously in immunocompromised mice. Endothelial cell migration and angiogenesis are evaluated 5–15 days later using immunohistochemistry techniques. 101P3A11 affects angiogenesis, and it is used as a target for diagnostic, prognostic, preventative and/or therapeutic purposes

119

Example 44

Regulation of Transcription

The cell surface localization of 101P3A11 and its similarity to GPCRs indicate that 101P3A11 is effectively used as a modulator of the transcriptional regulation of eukaryotic genes. Regulation of gene expression is confirmed, e.g., by studying gene expression in cells expressing or lacking 101P3A11. For this purpose, two types of experiments are performed.

In the first set of experiments, RNA from parental and 101P3A11-expressing cells are extracted and hybridized to commercially available gene arrays (Clontech) (Smid-Koopman E et al. Br J Cancer. 2000. 83:246). Resting cells as well as cells treated with FBS or androgen are compared. Differentially expressed genes are identified in accordance with procedures known in the art. The differentially expressed genes are then mapped to biological pathways (Chen K et al. Thyroid. 2001. 11:41.).

In the second set of experiments, specific transcriptional pathway activation is evaluated using commercially available (Stratagene) luciferase reporter constructs including: NFkB-luc, SRE-luc, ELK1-luc, ARE-luc, p53-luc, and CRE-luc. These transcriptional reporters contain consensus binding sites for known transcription factors that lie downstream of well-characterized signal transduction pathways, and represent a good tool to ascertain pathway activation and screen for positive and negative modulators of pathway activation.

Thus, 101P3A11 plays a role in gene regulation, and it is used as a target for diagnostic, prognostic, preventative and/or therapeutic purposes.

Example 45

Involvement in Cell Adhesion

Cell adhesion plays a critical role in tissue colonization and metastasis. 101P3A11 can participate in cellular organization, and as a consequence cell adhesion and motility. To confirm that 101P3A11 regulates cell adhesion, control cells lacking 101P3A11 are compared to cells expressing 101P3A11, using techniques previously described (see, e.g., Haier et al, Br. J. Cancer. 1999, 80:1867; Lehr and Pienta, J. Natl. Cancer Inst. 1998, 90:118). Briefly, in one embodiment, cells labeled with a fluorescent indicator, such as calcein, are incubated on tissue culture wells coated with media alone or with matrix proteins. Adherent cells are detected by fluorimetric analysis and percent adhesion is calculated. In another embodiment, cells lacking or expressing 101P3A11 are analyzed for their ability to mediate cell—cell adhesion using similar experimental techniques as described above. Both of these experimental systems are used to identify proteins, antibodies and/or small molecules that modulate cell adhesion to extracellular matrix and cell—cell interaction. Cell adhesion plays a critical role in tumor growth, progression, and, colonization, and 101P3A11 is involved in these processes. Thus, it serves as a diagnostic, prognostic, preventative and/or therapeutic modality.

120

Example 46

Protein—Protein Association

Several GPCRs have been shown to interact with other proteins, thereby regulating signal transduction, gene transcription, transformation and cell adhesion (Sexton P M et al, Cell Signal. 2001, 13:73; Turner C E, J Cell Sci. 2000, 23:4139). Using immunoprecipitation techniques as well as two yeast hybrid systems, proteins are identified that associate with 101P3A11. Immunoprecipitates from cells expressing 101P3A11 and cells lacking 101P3A11 are compared for specific protein—protein associations.

Studies are performed to confirm the extent of association of 101P3A11 with effector molecules, such as receptors, adaptor proteins and paxillin, kinases, phsophates and Ga proteins. Studies comparing 101P3A11 positive and 101P3A11 negative cells as well as studies comparing unstimulated/resting cells and cells treated with epithelial cell activators, such as cytokines, growth factors, androgen and anti-integrin Ab reveal unique interactions.

In addition, protein—protein interactions are confirmed using two yeast hybrid methodology (Curr Opin Chem Biol. 1999, 3:64). A vector carrying a library of proteins fused to the activation domain of a transcription factor is introduced into yeast expressing a 101P3A11-DNA-binding domain fusion protein and a reporter construct. Protein—protein interaction is detected by colorimetric reporter activity. Specific association with effector molecules and transcription factors directs one of skill to the mode of action of 101P3A11, and thus identifies therapeutic, prognostic, preventative and/or diagnostic targets for cancer. This and similar assays are also used to identify and screen for small molecules that interact with 101P3A11.

Thus it is found that 101P3A11 associates with proteins and small molecules. Accordingly, 101P3A11 and these proteins and small molecules are used for diagnostic, prognostic, preventative and/or therapeutic purposes.

Example 47

Biological Effect of Anti-101P3A11 Antibodies

The generation of anti-101P3A11 polyclonal Ab (pAb) using an amino-terminal peptide encoding amino acids 1–14 (MVDPNGNESSATYF; SEQ ID NO:2880) as antigen was reported in our Priority Application. The effect of this antibody on 101P3A11 mediated ERK phosphorylation (FIG. 38) and cAMP accumulation (FIG. 39) was determined. 293T cells were transfected with control or 101P3A11 cDNA. Cells were allowed to rest overnight, and treated with anti-101P3A11 or control Ab in the presence of 0.5% or 10% FBS. Cells were lysed and analyzed by Western blotting with anti-Phospho-ERK and anti-ERK mAb. FIG. 38 shows that expression of 101P3A11 induces ERK phosphorylation in cells treated with 0.5 or 10% FBS. Anti-101P3A11 pAb reduced the phosphorylation of ERK in 293T-101P3A11 cells treated with 0.5% FBS. The ERK overlay demonstrated equal loading, supporting the specificity of this data.

In order to confirm that anti-101P3A11 pAb has a detectable effect on cAMP accumulation, PC3 and PC3-101P3A11 cells were grown in 0.1% FBS and treated with anti-101P3A11 pAb. Cells were analyzed for cAMP content as described in FIG. 32. Expression of 101P3A11 induced a 5-fold increase in cAMP accumulation in PC3 cells, which was partially inhibited by PTX. Treatment of PC3-

101P3A11 cells with anti-101P3A11 pAb resulted in a 4-fold increase in cAMP accumulation in PC3-101P3A11 but not control PC3 cells. Results shown in FIG. 38 and FIG. 39 indicate that anti-101P3A11 pAb produces a measurable biological effect in cells expressing 101P3A11. Accordingly, 101P3A11 is used as a target for diagnostic, prognostic, preventative and/or therapeutic purposes.

Example 48

101P3A11 Promoters

A eukaryotic cells promoter is a short DNA sequence located in the 5' region of a gene. It provides binding sites for RNA polymerase and associated transcriptional cofactors, which upon assembly promotes transcription of the gene. In humans, most genes are transcribed by RNA polymerase II. The promoter DNA sequence normally contains binding motifs for RNA polymerases and its associated cofactors and activators including a TATA-box, cap signal, CCAAT-box and the GC-box. A eukaryotic cell enhancer is DNA sequence where transcriptional factors and their associated coactivators or suppressors bind and interact with promoter-bound RNA polymerase to regulate the expression of the gene located next to the promoter. While a promoter(s) locates close to the transcription starting site(s) of a gene (usually 25–30 base pairs), enhancers can be found up to 50,000 base pairs in either direction to the transcription starting site(s) of the gene. There are many different gene regulatory proteins, namely transcription factors and their associated coactivators and cosuppressors that bind to specific enhancer sequences and regulate gene expression. These proteins, upon interaction with specific DNA regulatory sequences and with each other, allow each gene to be regulated up or down in different tissues and cell types. Chapter 9. "Control of gene expression" in Molecular Biology of the Cell. $3^{rd}$ ed. Ed. by Alberts et al., (New York and London) Garland Publishing, 1994).

Tissue specific gene expression is associated with the presence of specific combinations of transcription factors and their associated coactivators and suppressors, the presence of specific binding sites present in the DNA regulatory region of the gene for these factors, and the activation or inactivation of signaling pathways that modulate their relative activity. For example, prostate specific expression of prostate specific antigen, (PSA, or human kallikrein 3), is dependent on the presence of androgen receptor binding elements in defined 5' upstream enhancer and promoter sequences of the gene and intact androgen receptor signaling pathway (Pang S, et al., Cancer Res 1997 Feb. 1; 57(3): 495–9). It is also dependent on the presence of other cis-acting DNA regulatory elements in the promoter region (Zhang J, et al., Nucleic Acids Res. 1997, Aug. 1; 25(15): 3143–50.) and on the expression of other transcription factors, such as the prostate specific ets-like transcription factor (Oettgen P, et al., J. Biol. Chem. 2000, Jan. 14; 275(2):1216–25).

With the accumulation of data and knowledge on human gene expression, promoters and enhancers are identified using different algorithms and computer programs (Chapter 8 "Gene Prediction" in Bioinformatics —Sequence and Genome Analysis, ed. by David W. Mount. Cold Spring Harbor Laboratory Press, 2001). Accordingly, we identified (Table XXX) promoters in a 5.04 kB 5' upstream genomic region of the 101P3A11 coding sequence using Neural Network Promoter Prediction computer program (http://www.fruitfly.org/seq_tools/nnppAbst.html; Reese, M. G. and Eeckman, F. H. (1995) Novel Neural Network Algorithms for Improved Eukaryotic Promoter Site Recognition. Accepted talk for The Seventh International Genome Sequencing and Analysis Conference, Hyatt Regency, Hilton Head Island, S.C., Sep. 16–20, 1995), indicated by the underlined sequences in Table XXIX. Using a program called SIGNAL SCAN (http://bimas.dcrt.nih.gov/molbio/signal/; Prestridge, D. S. (1991) SIGNAL SCAN: A computer program that scans DNA sequences for eukaryotic transcriptional elements. CABIOS 7, 203–206.), which searches a comprehensive database of regulatory element binding sites, we found numerous transcriptional binding sites for various known transcription factors in the 5.04 kB sequence 5' to the 101P3A11 gene, suggesting the presence of specific enhancer regions that may mediate tissue specific 101P3A11 transcription. Such transcription factors include, but are not limited to, NFAT, NF-1, NF-E, CP2, AP1, AP-2, Sp1, OCT-I, OCT-2, NFKB, CREB, CTF, TFIIA, TFIIB, TFIID, Pit-I, C/EBP, SRF, and various steroid receptors, such as glucocorticoid receptor (GR) and androgen receptors (AR) (Mitchell P J and Tijan R (1989) Science 245: 371). Comparison of the 5 kB upstream sequence of the 101P3A11 gene to the 5 kB upstream sequence of the PSA gene, 5 homologous regions were found that are important for prostate cell specific expression. Figure XXXI shows the alignment of the these sequences and also indicates predicted transcription factor binding sites common to both sequences identified using SIGNAL SCAN.

Experimentally, one defines the regions in the 5' genomic upstream regions of the 101P3A11 gene using various methods well known in the art, such as deletion and mutation analysis of the putative regulatory regions fused to a transcriptional reporter gene such as luciferase or chloramphenicol acetyl-transferase. These transcriptional reporter vectors are then introduced into cell lines, tissues, or transgenic animals to analyze the tissue and cell type specificity of transcription and expression of the reporter gene. To identify transcription factors and proteins that interact with specific 101P3A11 transcriptional regulatory sequences, one employs one or more of various techniques known in the art such as DNAse footprinting, gel mobility shift assays, and DNA/protein affinity chromatography. Various techniques concerning use of promoters are set forth, e.g., U.S. Pat. No. 5,919,652 which concerns embodiments of nucleic acid compositions that comprise prostate specific antigen (PSA) promoter alone or in combination with a cytomegalovirus (CMV) promoter and related uses.; and, U.S. Pat. No. 6,110,702 which concerns PSA positive regulatory sequence (PSAR) and related uses.

Once regulatory sequences are identified that mediate 101P3A11 tissue-specific expression, these sequences are employed in various gene therapeutic strategies for cancer, such as driving tissue-specific expression of a toxic gene or a cell suicide gene. Such cell suicide strategies are currently employed using the PSA-promoter enhancer using the thymidine kinase/ganciclovir system (Suzuki S, Tadakuma T, Asano T, Hayakawa M. Cancer Res. 2001 Feb. 15; 61(4): 1276–90). Unlike PSA, which is an androgen regulated gene, 101P3A11 does not exhibit androgen regulated expression. Thus, identification and use of regulatory sequences of the 101P3A11 gene that mediate, e.g., prostate-specific, but androgen insensitive gene expression, is useful for the treatment of both early stage androgen sensitive and late stage androgen insensitive or hormone refractory prostate cancer.

Throughout this application, various website data content, publications, patent applications and patents are referenced. (Websites are referenced by their Uniform Resource Locator, or URL, addresses on the World Wide Web.) The disclosures of each of these references are hereby incorporated by reference herein in their entireties.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLES

Table I: Exemplary Tissues that Express 101P3A11

Normal Tissues:

Prostate

Ovary (by RT-PCR only)

Malignant Tissues:

Rectum

Prostate

Colon

Kidney

Breast

Uterus

Cervix

Stomach

Metastases Pool

TABLE II

AMINO ACID ABBREVIATIONS

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

AMINO ACID SUBSTITUTION MATRIX

Adapted from the GCG Software 9.0 BLOSUM62 amino acid substitution matrix (block substitution matrix). The higher the value, the more likely a substitution is found in related, natural proteins. (See URL www.ikp.unibe.ch/manual/blosum62.html)

| A | C | D | E | F | G | H | I | K | L | M | N | P | Q | R | S | T | V | W | Y | . |
|---|---|---|---|---|---|---|---|---|---|---|---|---|---|---|---|---|---|---|---|---|
| 4 | 0 | -2 | -1 | -2 | 0 | -2 | -1 | -1 | -1 | -1 | -2 | -1 | -1 | -1 | 1 | 0 | 0 | -3 | -2 | A |
|   | 9 | -3 | -4 | -2 | -3 | -3 | -1 | -3 | -1 | -1 | -3 | -3 | -3 | -3 | -1 | -1 | -1 | -2 | -2 | C |
|   |   | 6 | 2 | -3 | -1 | -1 | -3 | -1 | -4 | -3 | 1 | -1 | 0 | -2 | 0 | -1 | -3 | -4 | -3 | D |
|   |   |   | 5 | -3 | -2 | 0 | -3 | 1 | -3 | -2 | 0 | -1 | 2 | 0 | 0 | -1 | -2 | -3 | -2 | E |
|   |   |   |   | 6 | -3 | -1 | 0 | -3 | 0 | 0 | -3 | -4 | -3 | -3 | -2 | -2 | -1 | 1 | 3 | F |
|   |   |   |   |   | 6 | -2 | -4 | -2 | -4 | -3 | 0 | -2 | -2 | -2 | 0 | -2 | -3 | -2 | -3 | G |
|   |   |   |   |   |   | 8 | -3 | -1 | -3 | -2 | 1 | -2 | 0 | 0 | -1 | -2 | -3 | -2 | 2 | H |
|   |   |   |   |   |   |   | 4 | -3 | 2 | 1 | -3 | -3 | -3 | -3 | -2 | -1 | 3 | -3 | -1 | I |
|   |   |   |   |   |   |   |   | 5 | -2 | -1 | 0 | -1 | 1 | 2 | 0 | -1 | -2 | -3 | -2 | K |
|   |   |   |   |   |   |   |   |   | 4 | 2 | -3 | -3 | -2 | -2 | -2 | -1 | 1 | -2 | -1 | L |
|   |   |   |   |   |   |   |   |   |   | 5 | -2 | -2 | 0 | -1 | -1 | -1 | 1 | -1 | -1 | M |
|   |   |   |   |   |   |   |   |   |   |   | 6 | -2 | 0 | 0 | 1 | 0 | -3 | -4 | -2 | N |
|   |   |   |   |   |   |   |   |   |   |   |   | 7 | -1 | -2 | -1 | -1 | -2 | -4 | -3 | P |
|   |   |   |   |   |   |   |   |   |   |   |   |   | 5 | 1 | 0 | -1 | -2 | -2 | -1 | Q |
|   |   |   |   |   |   |   |   |   |   |   |   |   |   | 5 | -1 | -1 | -3 | -3 | -2 | R |
|   |   |   |   |   |   |   |   |   |   |   |   |   |   |   | 4 | 1 | -2 | -3 | -2 | S |
|   |   |   |   |   |   |   |   |   |   |   |   |   |   |   |   | 5 | 0 | -2 | -2 | T |
|   |   |   |   |   |   |   |   |   |   |   |   |   |   |   |   |   | 4 | -3 | -1 | V |
|   |   |   |   |   |   |   |   |   |   |   |   |   |   |   |   |   |   | 11 | 2 | W |
|   |   |   |   |   |   |   |   |   |   |   |   |   |   |   |   |   |   |   | 7 | Y |

Adapted from the GCG Software 9.0 BLOSUM62 amino acid substitution matrix (block substitution matrix). The higher the value, the more likely a substitution is found in related, natural proteins. (See URL www.ikp.unibe.ch/manual/blosum62.html)

TABLE IV (A)

| | POSITION 2 (Primary Anchor) | POSITION 3 (Primary Anchor) | POSITION C Terminus (Primary Anchor) |
|---|---|---|---|
| SUPERMOTIFS | | | |
| A1 | T I L*V M S* | | F W Y |
| A2 | L I V M *A T Q* | | I V M *A T L* |
| A3 | V S M A *T L I* | | R K |
| A24 | Y F *W I V L M T* | | F I *Y W L M* |
| B7 | P | | V I L F *M W Y A* |
| B27 | R H K | | F Y L *W M I V A* |

TABLE IV (A)-continued

| | POSITION 2 (Primary Anchor) | POSITION 3 (Primary Anchor) | POSITION C Terminus (Primary Anchor) |
|---|---|---|---|
| B44 | E*D* | | FWY*LIMVA* |
| B58 | ATS | | FWY*LIVMA* |
| B62 | QL*IVMP* | | FWY*MIVLA* |
| MOTIFS | | | |
| A1 | TSM | | Y |
| A1 | | DE*AS* | Y |
| A2.1 | LM*VQIAT* | | V*LIMAT* |
| A3 | LMVISATF*CGD* | | KYR*HFA* |
| A11 | VTMLISAGN*CDF* | | KR*YH* |
| A24 | YFW*M* | | FLIW |
| A*3101 | MVT*ALIS* | | R*K* |
| A*3301 | MVALF*IST* | | RK |
| A*6801 | AVT*MSLI* | | RK |
| B*0702 | P | | LMF*WYAIV* |
| B*3501 | P | | LMFWY*IVA* |
| B51 | P | | LIVF*WYAM* |
| B*5301 | P | | IMFWY*ALV* |
| B*5401 | P | | ATIV*LMFWY* |

Bolded residues are preferred, italicized residues are less preferred: A peptide is considered motif-bearing if it has primary anchors at each primary anchor position for a motif or supermotif as specified in the above table.

TABLE IV (B)

| HLA CLASS II SUPERMOTIF | | |
|---|---|---|
| 1 | 6 | 9 |
| W, F, Y, V, .I, L | A, V, I, L, P, C, S, T | A, V, I, L, C, S, T, M, Y |

TABLE IV (C)

| MOTIFS | | 1° anchor 1 | 2 | 3 | 4 | 5 | 1° anchor 6 | 7 | 8 | 9 |
|---|---|---|---|---|---|---|---|---|---|---|
| DR4 | preferred | FMY*LIVW* | M | T | | I | VSTC*PALIM* | MH | | MH |
| | deleterious | | | | W | | | R | | WDE |
| DR1 | preferred | MF*LIVWY* | | | PAMQ | | VMAT*SPLIC* | M | | AVM |
| | deleterious | | C | CH | FD | CWD | | GDE | D | |
| DR7 | preferred | MF*LIVWY* | M | W | A | | IVMS*ACTPL* | M | | IV |
| | deleterious | | C | | G | | | GRD | N | G |

| DR3 | MOTIFS | 1° anchor 1 | 2 | 3 | 1° anchor 4 | 5 | 1° anchor 6 |
|---|---|---|---|---|---|---|---|
| | motif a preferred | LIVMFY | | | D | | |
| | motif b preferred | LIVMFAY | | | DNQEST | | KRH |
| | DR Supermotif | MF*LIVWY* | | | | | VMSTA*CPLI* |

Italicized residues indicate less preferred or "tolerated" residues.

TABLE IV (D)

| SUPERMOTIFS | | 1 | 2 | 3 | 4 | 5 | 6 | 7 | 8 | C-terminus |
|---|---|---|---|---|---|---|---|---|---|---|
| A1 | | | 1° Anchor TI*LVMS* | | | | | | | 1° Anchor FWY |
| A2 | | | 1° Anchor LIVMA*TQ* | | | | | | | 1° Anchor LIVMAT |
| A3 | preferred | | 1° Anchor VSMA*TLI* | YFW (4/5) | | | YFW (3/5) | YFW (4/5) | P (4/5) | 1° Anchor RK |
| | deleterious | DE (3/5); P (5/5) | | DE (4/5) | | | | | | |
| A24 | | | 1° Anchor YF*WIVLMT* | | | | | | | 1° Anchor FIY*WLM* |
| B7 | preferred | FWY (5/5) LIVM (3/5) | 1° Anchor P | FWY (4/5) | | | | FWY (3/5) | | 1° Anchor VILF*MWYA* |
| | deleterious | DE (3/5); P (5/5); G (4/5); A (3/5); QN (3/5) | | | | DE (3/5) | G (4/5) | QN (4/5) | DE (4/5) | |
| B27 | | | 1° Anchor RHK | | | | | | | 1° Anchor FYL*WMIVA* |
| B44 | | | 1° Anchor E*D* | | | | | | | 1° Anchor FWY*LIMVA* |
| B58 | | | 1° Anchor ATS | | | | | | | 1° Anchor FWY*LIVMA* |
| B62 | | | 1° Anchor QL*IVMP* | | | | | | | 1° Anchor FWY*MIVLA* |

TABLE IV (E)

| | | 1 | 2 | 3 | 4 | 5 |
|---|---|---|---|---|---|---|
| A1 9-mer | preferred | GFYW | 1° Anchor STM | DEA | YFW | |
| | deleterious | DE | | RHKLIVMP | A | G |
| A1 9-mer | preferred | GRHK | ASTCLIVM | 1° Anchor DE*AS* | GSTC | |
| | deleterious | A | RHKDEPYFW | | DE | PQN |
| A1 10-mer | preferred | YFW | 1° Anchor STM | DEAQN | A | YFWQN |
| | deleterious | GP | | RHKGLIVM | DE | RHK |
| A1 10-mer | preferred | YFW | STCLIVM | 1° Anchor DE*AS* | A | YFW |
| | deleterious | RHK | RHKDEPYFW | | | P |
| A2.1 9-mer | preferred | YFW | 1° Anchor LM*IVQAT* | YFW | STC | YFW |
| | deleterious | DEP | | DERKH | | |
| A2.1 10-mer | preferred | AYFW | 1° Anchor LM*IVQAT* | LVIM | G | |
| | deleterious | DEP | | DE | RKHA | P |
| A3 | preferred | RHK | 1° Anchor LMVIS*ATFCGD* | YFW | PRHKYFW | A |
| | deleterious | DEP | | DE | | |
| A11 | preferred | A | 1° Anchor VTLMIS*AGNCDF* | YFW | YFW | A |
| | deleterious | DEP | | | | |
| A24 9-mer | preferred | YFWRHK | 1° Anchor YFW*M* | | STC | |
| | deleterious | DEG | | DE | G | QNP |
| A24 10-mer | preferred | | 1° Anchor YFW*M* | | P | YFWP |
| | deleterious | | | GDE | QN | RHK |
| A3101 | preferred | RHK | 1° Anchor MVT*ALIS* | YFW | P | |
| | deleterious | DEP | | DE | | ADE |
| A3301 | preferred | | 1° Anchor MVALF*IST* | YFW | | |
| | deleterious | GP | | DE | | |
| A6801 | preferred | YFWSTC | 1° Anchor AVT*MSLI* | | | YFWLIVM |
| | deleterious | GP | | DEG | | RHK |
| B0702 | preferred | RHKFWY | 1° Anchor P | RHK | | RHK |
| | deleterious | DEQNP | | DEP | DE | DE |
| B3501 | preferred | FWYLIVM | 1° Anchor P | FWY | | |
| | deleterious | AGP | | | | G |
| B51 | preferred | LIVMFWY | 1° Anchor P | FWY | STC | FWY |
| | deleterious | AGPDERHKSTC | | | | DE |
| B5301 | preferred | LIVMFWY | 1° Anchor P | FWY | STC | FWY |
| | deleterious | AGPQN | | | | |
| B5401 | preferred | FWY | 1° Anchor P | FWYLIVM | | LIVM |
| | deleterious | GPQNDE | | GDESTC | | RHKDE |

| | | 6 | 7 | 8 | 9 or C-terminus | C-terminus |
|---|---|---|---|---|---|---|
| A1 9-mer | preferred | P | DEQN | YFW | 1° Anchor Y | |
| | deleterious | A | | | | |
| A1 9-mer | preferred | ASTC | LIVM | DE | 1° Anchor Y | |
| | deleterious | RHK | PG | GP | | |
| A1 10-mer | preferred | | PASTC | GDE | P | 1° Anchor Y |
| | deleterious | QNA | RHKYFW | RHK | A | |
| A1 10-mer | preferred | | PG | G | YFW | 1° Anchor Y |
| | deleterious | G | | PRHK | QN | |
| A2.1 9-mer | preferred | | A | P | 1° Anchor V*LIMAT* | |
| | deleterious | RKH | DERKH | | | |
| A2.1 10-mer | preferred | G | | FYWL VIM | | 1° Anchor V*LIMAT* |
| | deleterious | | RKH | DERKH | RKH | |

TABLE IV (E)-continued

| | | | | | |
|---|---|---|---|---|---|
| A3 | preferred | YFW | | P | 1° Anchor KYR*HFA* |
| | deleterious | | | | |
| A11 | preferred | YFW | YFW | P | 1° Anchor K*RYH* |
| | deleterious | | A | G | |
| A24 9-mer | preferred | | YFW | YFW | 1° Anchor FLIW |
| | deleterious | DERHK | G | AQN | |
| A24 10-mer | preferred | | P | | 1° Anchor FLIW |
| | deleterious | DE | A | QN | DEA |
| A3101 | preferred | YFW | YFW | AP | 1° Anchor R*K* |
| | deleterious | DE | DE | DE | |
| A3301 | preferred | | AYFW | | 1° Anchor RK |
| | deleterious | | | | |
| A6801 | preferred | | YFW | P | 1° Anchor RK |
| | deleterious | | | A | |
| B0702 | preferred | RHK | RHK | PA | 1° Anchor LMF*WYAIV* |
| | deleterious | GDE | QN | DE | |
| B3501 | preferred | | FWY | | 1° Anchor LMFWY*IVA* |
| | deleterious | G | | | |
| B51 | preferred | | G | FWY | 1° Anchor LIVF*WYAM* |
| | deleterious | G | DEQN | GDE | |
| B5301 | preferred | | LIVMFWY | FWY | 1° Anchor IMFWY*ALV* |
| | deleterious | G | RHKQN | DE | |
| B5401 | preferred | | ALIVM | FWYAP | 1° Anchor ATIV*LMFWY* |
| | deleterious | DE | QNDGE | DE | |

Italicized residues indicate less preferred or "tolerated" residues. The information in this Table is specific for 9-mers unless otherwise specified.

TABLE V

HLA PEPTIDE SCORING RESULTS-101P3A11- A1, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 210 | GLDSLLISF | 25.000 | 1. |
| 2 | 1 | MVDPNGNES | 5.000 | 2. |
| 3 | 29 | LAFPLCSLY | 5.000 | 3. |
| 4 | 21 | GLEEAQFWL | 4.500 | 4. |
| 5 | 212 | DSLLISFSY | 3.750 | 5. |
| 6 | 41 | VLGNLTIIY | 2.500 | 6. |
| 7 | 245 | HVCAVFIFY | 2.500 | 7. |
| 8 | 57 | LHEPMYIFL | 2.250 | 8. |
| 9 | 111 | GMESTVLLA | 2.250 | 9. |
| 10 | 6 | GNESSATYF | 2.250 | 10. |
| 11 | 259 | LSMVHRFSK | 1.500 | 11. |
| 12 | 114 | STVLLAMAF | 1.250 | 12. |
| 13 | 190 | ACDDIRVNV | 1.000 | 13. |
| 14 | 74 | LISTSSMPK | 1.000 | 14. |
| 15 | 158 | MAPLPVFIK | 1.000 | 15. |
| 16 | 78 | SSMPKMLAI | 0.750 | 16. |
| 17 | 172 | RSNILSHSY | 0.750 | 17. |
| 18 | 134 | HATVLTLPR | 0.500 | 18. |
| 19 | 44 | NLTIIYIVR | 0.500 | 19. |
| 20 | 117 | LLAMAFDRY | 0.500 | 20. |
| 21 | 116 | VLLAMAFDR | 0.500 | 21. |
| 22 | 70 | GIDILISTS | 0.500 | 22. |
| 23 | 231 | TREAQAKAF | 0.450 | 23. |
| 24 | 180 | YCLHQDVMK | 0.400 | 24. |
| 25 | 137 | VLTLPRVTK | 0.400 | 25. |
| 26 | 183 | HQDVMKLAC | 0.375 | 26. |
| 27 | 5 | NGNESSATY | 0.250 | 27. |
| 28 | 138 | LTLPRVTKI | 0.250 | 28. |
| 29 | 52 | RTEHSLHEP | 0.225 | 29. |

TABLE V-continued

HLA PEPTIDE SCORING RESULTS-101P3A11- A1, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 30 | 145 | KIGVAAVVR | 0.200 | 30. |
| 31 | 56 | SLHEPMYIF | 0.200 | 31. |
| 32 | 242 | CVSHVCAVF | 0.200 | 32. |
| 33 | 256 | FIGLSMVHR | 0.200 | 33. |
| 34 | 287 | VLNPIVYGV | 0.200 | 34. |
| 35 | 156 | ALMAPLPVF | 0.200 | 35. |
| 36 | 125 | YVAICHPLR | 0.200 | 36. |
| 37 | 248 | AVFIFYVPF | 0.200 | 37. |
| 38 | 273 | LPVILANIY | 0.125 | 38. |
| 39 | 95 | QFDACLLQI | 0.125 | 39. |
| 40 | 271 | SPLPVILAN | 0.125 | 40. |
| 41 | 11 | ATYFILIGL | 0.125 | 41. |
| 42 | 159 | APLPVFIKQ | 0.125 | 42. |
| 43 | 128 | ICHPLRHAT | 0.100 | 43. |
| 44 | 157 | LMAPLPVFI | 0.100 | 44. |
| 45 | 283 | LVPPVLNPI | 0.100 | 45. |
| 46 | 77 | TSSMPKMLA | 0.075 | 46. |
| 47 | 68 | LSGIDILIS | 0.075 | 47. |
| 48 | 176 | LSHSYCLHQ | 0.075 | 48. |
| 49 | 9 | SSATYFILI | 0.075 | 49. |
| 50 | 8 | ESSATYFIL | 0.075 | 50. |
| 51 | 218 | FSYLLILKT | 0.075 | 51. |
| 52 | 216 | ISFSYLLIL | 0.075 | 52. |
| 53 | 90 | NSTTIQFDA | 0.075 | 53. |
| 54 | 55 | HSLHEPMYI | 0.075 | 54. |
| 55 | 270 | DSPLPVILA | 0.075 | 55. |
| 56 | 285 | PPVLNPIVY | 0.062 | 56. |
| 57 | 233 | EAQAKAFGT | 0.050 | 57. |
| 58 | 203 | IVIISAIGL | 0.050 | 58. |
| 59 | 188 | KLACDDIRV | 0.050 | 59. |
| 60 | 97 | DACLLQIFA | 0.050 | 60. |
| 61 | 19 | LPGLEEAQF | 0.050 | 61. |
| 62 | 253 | YVPFIGLSM | 0.050 | 62. |
| 63 | 98 | ACLLQIFAI | 0.050 | 63. |
| 64 | 164 | FIKQLPFCR | 0.050 | 64. |
| 65 | 33 | LCSLYLIAV | 0.050 | 65. |
| 66 | 288 | LNPIVYGVK | 0.050 | 66. |
| 67 | 260 | SMVHRFSKR | 0.050 | 67. |
| 68 | 67 | MLSGIDILI | 0.050 | 68. |
| 69 | 126 | VAICHPLRH | 0.050 | 69. |
| 70 | 240 | GTCVSHVCA | 0.050 | 70. |
| 71 | 54 | EHSLHEPMY | 0.050 | 71. |
| 72 | 276 | ILANIYLLV | 0.050 | 72. |
| 73 | 215 | LISFSYLLI | 0.050 | 73. |
| 74 | 217 | SFSYLLILK | 0.050 | 74. |
| 75 | 83 | MLAIFWFNS | 0.050 | 75. |
| 76 | 39 | IAVLGNLTI | 0.050 | 76. |
| 77 | 246 | VCAVFIFYV | 0.050 | 77. |
| 78 | 162 | PVFIKQLPF | 0.050 | 78. |
| 79 | 208 | AIGLDSLLI | 0.050 | 79. |
| 80 | 250 | FIFYVPFIG | 0.050 | 80. |
| 81 | 155 | AALMAPLPV | 0.050 | 81. |
| 82 | 65 | LCMLSGIDI | 0.050 | 82. |
| 83 | 10 | SATYFILIG | 0.050 | 83. |
| 84 | 268 | RRDSPLPVI | 0.050 | 84. |
| 85 | 92 | TTIQFDACL | 0.050 | 85. |
| 86 | 181 | CLHQDVMKL | 0.050 | 86. |
| 87 | 62 | YIFLCMLSG | 0.050 | 87. |
| 88 | 197 | NVVYGLIVI | 0.050 | 88. |
| 89 | 135 | ATVLTLPRV | 0.050 | 89. |
| 90 | 100 | LLQIFAIHS | 0.050 | 90. |
| 91 | 282 | LLVPPVLNP | 0.050 | 91. |
| 92 | 45 | LTIIYIVRT | 0.050 | 92. |
| 93 | 205 | IISAIGLDS | 0.050 | 93. |
| 94 | 22 | LEEAQFWLA | 0.045 | 94. |
| 95 | 297 | TKEIRQRIL | 0.045 | 95. |
| 96 | 113 | ESTVLLAMA | 0.030 | 96. |
| 97 | 243 | VSHVCAVFI | 0.030 | 97. |
| 98 | 75 | ISTSSMPKM | 0.030 | 98. |
| 99 | 34 | CSLYLIAVL | 0.030 | 99. |
| 100 | 224 | LKTVLGLTR | 0.025 | 100. |

TABLE VI

HLA PEPTIDE SCORING RESULTS-101P3A11- A1, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 1 | MVDPNGNESS | 5.000 | 101. |
| 2 | 157 | LMAPLPVFIK | 5.000 | 102. |
| 3 | 78 | SSMPKMLAIF | 3.000 | 103. |
| 4 | 40 | AVLGNLTIIY | 2.500 | 104. |
| 5 | 191 | CDDIRVNVVY | 2.500 | 105. |
| 6 | 57 | LHEPMYIFLC | 2.250 | 106. |
| 7 | 22 | LEEAQFWLAF | 2.250 | 107. |
| 8 | 297 | TKEIRQRILR | 2.250 | 108. |
| 9 | 52 | RTEHSLHEPM | 2.250 | 109. |
| 10 | 111 | GMESTVLLAM | 2.250 | 110. |
| 11 | 287 | VLNPIVYGVK | 2.000 | 111. |
| 12 | 216 | ISFSYLLILK | 1.500 | 112. |
| 13 | 73 | ILISTSSMPK | 1.000 | 113. |
| 14 | 258 | GLSMVHRFSK | 1.000 | 114. |
| 15 | 21 | GLEEAQFWLA | 0.900 | 115. |
| 16 | 113 | ESTVLLAMAF | 0.750 | 116. |
| 17 | 243 | VSHVCAVFIF | 0.750 | 117. |
| 18 | 284 | VPPVLNPIVY | 0.625 | 118. |
| 19 | 29 | LAFPLCSLYL | 0.500 | 119. |
| 20 | 70 | GIDILISTSS | 0.500 | 120. |
| 21 | 116 | VLLAMAFDRY | 0.500 | 121. |
| 22 | 115 | TVLLAMAFDR | 0.500 | 122. |
| 23 | 210 | GLDSLLISFS | 0.500 | 123. |
| 24 | 190 | ACDDIRVNVV | 0.500 | 124. |
| 25 | 28 | WLAFPLCSLY | 0.500 | 125. |
| 26 | 6 | GNESSATYFI | 0.450 | 126. |
| 27 | 136 | TVLTLPRVTK | 0.400 | 127. |
| 28 | 55 | HSLHEPMYIF | 0.300 | 128. |
| 29 | 95 | QFDACLLQIF | 0.250 | 129. |
| 30 | 138 | LTLPRVTKIG | 0.250 | 130. |
| 31 | 128 | ICHPLRHATV | 0.200 | 131. |
| 32 | 155 | AALMAPLPVF | 0.200 | 132. |
| 33 | 247 | CAVFIFYVPF | 0.200 | 133. |
| 34 | 283 | LVPPVLNPIV | 0.200 | 134. |
| 35 | 241 | TCVSHVCAVF | 0.200 | 135. |
| 36 | 18 | GLPGLEEAQF | 0.200 | 136. |
| 37 | 259 | LSMVHRFSKR | 0.150 | 137. |
| 38 | 43 | GNLTIIYIVR | 0.125 | 138. |
| 39 | 244 | SHVCAVFIFY | 0.125 | 139. |
| 40 | 209 | IGLDSLLISF | 0.125 | 140. |
| 41 | 161 | LPVFIKQLPF | 0.125 | 141. |
| 42 | 211 | LDSLLISFSY | 0.125 | 142. |
| 43 | 76 | STSSMPKMLA | 0.125 | 143. |
| 44 | 256 | FIGLSMVHRF | 0.100 | 144. |
| 45 | 282 | LLVPPVLNPI | 0.100 | 145. |
| 46 | 231 | TREAQAKAFG | 0.090 | 146. |
| 47 | 77 | TSSMPKMLAI | 0.075 | 147. |
| 48 | 270 | DSPLPVILAN | 0.075 | 148. |
| 49 | 8 | ESSATYFILI | 0.075 | 149. |
| 50 | 68 | LSGIDILIST | 0.075 | 150. |
| 51 | 9 | SSATYFILIG | 0.075 | 151. |
| 52 | 272 | PLPVILANIY | 0.050 | 152. |
| 53 | 214 | LLISFSYLLI | 0.050 | 153. |
| 54 | 245 | HVCAVFIFYV | 0.050 | 154. |
| 55 | 175 | ILSHSYCLHQ | 0.050 | 155. |
| 56 | 289 | NPIVYGVKTK | 0.050 | 156. |
| 57 | 41 | VLGNLTIIYI | 0.050 | 157. |
| 58 | 105 | AIHSLSGMES | 0.050 | 158. |
| 59 | 125 | YVAICHPLRH | 0.050 | 159. |
| 60 | 202 | LIVIISAIGL | 0.050 | 160. |
| 61 | 260 | SMVHRFSKRR | 0.050 | 161. |
| 62 | 97 | DACLLQIFAI | 0.050 | 162. |
| 63 | 56 | SLHEPMYIFL | 0.050 | 163. |
| 64 | 35 | SLYLIAVLGN | 0.050 | 164. |
| 65 | 195 | RVNVVYGLIV | 0.050 | 165. |
| 66 | 215 | LISFSYLLIL | 0.050 | 166. |
| 67 | 221 | LLILKTVLGL | 0.050 | 167. |
| 68 | 67 | MLSGIDILIS | 0.050 | 168. |
| 69 | 268 | RRDSPLPVIL | 0.050 | 169. |
| 70 | 271 | SPLPVILANI | 0.050 | 170. |
| 71 | 207 | SAIGLDSLLI | 0.050 | 171. |
| 72 | 102 | QIFAIHSLSG | 0.050 | 172. |
| 73 | 64 | FLCMLSGIDI | 0.050 | 173. |

TABLE VI-continued

HLA PEPTIDE SCORING RESULTS-101P3A11- A1, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 74 | 208 | AIGLDSLLIS | 0.050 | 174. |
| 75 | 204 | VIISAIGLDS | 0.050 | 175. |
| 76 | 93 | TIQFDACLLQ | 0.050 | 176. |
| 77 | 275 | VILANIYLLV | 0.050 | 177. |
| 78 | 10 | SATYFILIGL | 0.050 | 178. |
| 79 | 198 | VVYGLIVIIS | 0.050 | 179. |
| 80 | 24 | EAQFWLAFPL | 0.050 | 180. |
| 81 | 154 | GAALMAPLPV | 0.050 | 181. |
| 82 | 91 | STTIQFDACL | 0.050 | 182. |
| 83 | 228 | LGLTREAQAK | 0.050 | 183. |
| 84 | 99 | CLLQIFAIHS | 0.050 | 184. |
| 85 | 38 | LIAVLGNLTI | 0.050 | 185. |
| 86 | 53 | TEHSLHEPMY | 0.050 | 186. |
| 87 | 223 | ILKTVLGLTR | 0.050 | 187. |
| 88 | 158 | MAPLPVFIKQ | 0.050 | 188. |
| 89 | 250 | FIFYVPFIGL | 0.050 | 189. |
| 90 | 180 | YCLHQDVMKL | 0.050 | 190. |
| 91 | 109 | LSGMESTVLL | 0.030 | 191. |
| 92 | 34 | CSLYLIAVLG | 0.030 | 192. |
| 93 | 225 | KTVLGLTREA | 0.025 | 193. |
| 94 | 5 | NGNESSATYF | 0.025 | 194. |
| 95 | 230 | LTREAQAKAF | 0.025 | 195. |
| 96 | 171 | CRSNILSHSY | 0.025 | 196. |
| 97 | 87 | FWFNSTTIQF | 0.025 | 197. |
| 98 | 17 | IGLPGLEEAQ | 0.025 | 198. |
| 99 | 82 | KMLAIFWFNS | 0.025 | 199. |
| 100 | 4 | PNGNESSATY | 0.025 | 200. |

TABLE VII

HLA PEPTIDE SCORING RESULTS-101P3A11- A0201, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 213 | SLLISFSYL | 825.977 | 201. |
| 2 | 287 | VLNPIVYGV | 271.948 | 202. |
| 3 | 188 | KLACDDIRV | 243.432 | 203. |
| 4 | 28 | WLAFPLCSL | 226.014 | 204. |
| 5 | 246 | VCAVFIFYV | 215.192 | 205. |
| 6 | 21 | GLEEAQFWL | 178.815 | 206. |
| 7 | 276 | ILANIYLLV | 177.358 | 207. |
| 8 | 220 | YLLILKTVL | 149.071 | 208. |
| 9 | 214 | LLISFSYLL | 138.001 | 209. |
| 10 | 14 | FILIGLPGL | 114.985 | 210. |
| 11 | 157 | LMAPLPVFI | 70.450 | 211. |
| 12 | 279 | NIYLLVPPV | 70.387 | 212. |
| 13 | 108 | SLSGMESTV | 69.552 | 213. |
| 14 | 82 | KMLAIFWFN | 54.625 | 214. |
| 15 | 181 | CLHQDVMKL | 49.134 | 215. |
| 16 | 25 | AQFWLAFPL | 46.480 | 216. |
| 17 | 275 | VILANIYLL | 42.494 | 217. |
| 18 | 222 | LILKTVLGL | 42.494 | 218. |
| 19 | 37 | YLIAVLGNL | 29.382 | 219. |
| 20 | 66 | CMLSGIDIL | 26.377 | 220. |
| 21 | 118 | LAMAFDRYV | 25.398 | 221. |
| 22 | 201 | GLIVIISAI | 23.995 | 222. |
| 23 | 306 | RLFHVATHA | 18.382 | 223. |
| 24 | 67 | MLSGIDILI | 17.736 | 224. |
| 25 | 85 | AIFWFNSTT | 14.407 | 225. |
| 26 | 49 | YIVRTEHSL | 13.512 | 226. |
| 27 | 174 | NILSHSYCL | 10.868 | 227. |
| 28 | 167 | QLPFCRSNI | 10.433 | 228. |
| 29 | 60 | PMYIFLCML | 9.493 | 229. |
| 30 | 101 | LQIFAIHSL | 8.469 | 230. |
| 31 | 254 | VPFIGLSMV | 6.568 | 231. |
| 32 | 120 | MAFDRYVAI | 5.605 | 232. |
| 33 | 83 | MLAIFWFNS | 4.747 | 233. |
| 34 | 198 | VVYGLIVII | 4.683 | 234. |

TABLE VII-continued

HLA PEPTIDE SCORING RESULTS-101P3A11- A0201, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 35 | 160 | PLPVFIKQL | 4.108 | 235. |
| 36 | 304 | ILRLFHVAT | 3.659 | 236. |
| 37 | 215 | LISFSYLLI | 3.658 | 237. |
| 38 | 155 | AALMAPLPV | 3.574 | 238. |
| 39 | 283 | LVPPVLNPI | 3.569 | 239. |
| 40 | 98 | ACLLQIFAI | 3.361 | 240. |
| 41 | 40 | AVLGNLTII | 3.185 | 241. |
| 42 | 203 | IVIISAIGL | 3.178 | 242. |
| 43 | 93 | TIQFDACLL | 2.937 | 243. |
| 44 | 31 | FPLCSLYLI | 2.666 | 244. |
| 45 | 135 | ATVLTLPRV | 2.222 | 245. |
| 46 | 11 | ATYFILIGL | 2.184 | 246. |
| 47 | 110 | SGMESTVLL | 2.115 | 247. |
| 48 | 138 | LTLPRVTKI | 2.096 | 248. |
| 49 | 253 | YVPFIGLSM | 2.000 | 249. |
| 50 | 303 | RILRLFHVA | 1.969 | 250. |
| 51 | 33 | LCSLYLIAV | 1.775 | 251. |
| 52 | 38 | LIAVLGNLT | 1.742 | 252. |
| 53 | 218 | FSYLLILKT | 1.647 | 253. |
| 54 | 43 | GNLTIIYIV | 1.584 | 254. |
| 55 | 119 | AMAFDRYVA | 1.471 | 255. |
| 56 | 42 | LGNLTIIYI | 1.465 | 256. |
| 57 | 208 | AIGLDSLLI | 1.435 | 257. |
| 58 | 200 | YGLIVIISA | 1.270 | 258. |
| 59 | 281 | YLLVPPVLN | 1.268 | 259. |
| 60 | 92 | TTIQFDACL | 1.127 | 260. |
| 61 | 7 | NESSATYFI | 1.116 | 261. |
| 62 | 241 | TCVSHVCAV | 1.044 | 262. |
| 63 | 197 | NVVYGLIVI | 0.861 | 263. |
| 64 | 216 | ISFSYLLIL | 0.827 | 264. |
| 65 | 190 | ACDDIRVNV | 0.745 | 265. |
| 66 | 104 | FAIHSLSGM | 0.730 | 266. |
| 67 | 243 | VSHVCAVFI | 0.637 | 267. |
| 68 | 78 | SSMPKMLAI | 0.580 | 268. |
| 69 | 116 | VLLAMAFDR | 0.544 | 269. |
| 70 | 111 | GMESTVLLA | 0.528 | 270. |
| 71 | 272 | PLPVILANI | 0.528 | 271. |
| 72 | 34 | CSLYLIAVL | 0.487 | 272. |
| 73 | 100 | LLQIFAIHS | 0.481 | 273. |
| 74 | 69 | SGIDILIST | 0.459 | 274. |
| 75 | 142 | RVTKIGVAA | 0.435 | 275. |
| 76 | 150 | AVVRGAALM | 0.435 | 276. |
| 77 | 65 | LCMLSGIDI | 0.428 | 277. |
| 78 | 250 | FIFYVPFIG | 0.415 | 278. |
| 79 | 45 | LTIIYIVRT | 0.405 | 279. |
| 80 | 62 | YIFLCMLSG | 0.401 | 280. |
| 81 | 112 | MESTVLLAM | 0.378 | 281. |
| 82 | 168 | LPFCRSNIL | 0.360 | 282. |
| 83 | 84 | LAIFWFNST | 0.334 | 283. |
| 84 | 226 | TVLGLTREA | 0.322 | 284. |
| 85 | 153 | RGAALMAPL | 0.321 | 285. |
| 86 | 284 | VPPVLNPIV | 0.316 | 286. |
| 87 | 196 | VNVVYGLIV | 0.316 | 287. |
| 88 | 127 | AICHPLRHA | 0.314 | 288. |
| 89 | 149 | AAVVRGAAL | 0.297 | 289. |
| 90 | 207 | SAIGLDSLL | 0.297 | 290. |
| 91 | 76 | STSSMPKML | 0.297 | 291. |
| 92 | 56 | SLHEPMYIF | 0.288 | 292. |
| 93 | 206 | ISAIGLDSL | 0.267 | 293. |
| 94 | 156 | ALMAPLPVF | 0.260 | 294. |
| 95 | 39 | IAVLGNLTI | 0.246 | 295. |
| 96 | 35 | SLYLIAVLG | 0.238 | 296. |
| 97 | 17 | IGLPGLEEA | 0.230 | 297. |
| 98 | 274 | PVILANIYL | 0.226 | 298. |
| 99 | 186 | VMKLACDDI | 0.220 | 299. |
| 100 | 99 | CLLQIFAIH | 0.215 | 300. |

TABLE VIII

HLA PEPTIDE SCORING RESULTS-101P3A11- A0201, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 56 | SLHEPMYIFL | 722.583 | 301. |
| 2 | 117 | LLAMAFDRYV | 494.237 | 302. |
| 3 | 213 | SLLISFSYLL | 300.355 | 303. |
| 4 | 41 | VLGNLTIIYI | 224.357 | 304. |
| 5 | 156 | ALMAPLPVFI | 212.307 | 305. |
| 6 | 250 | FIFYVPFIGL | 94.987 | 306. |
| 7 | 275 | VILANIYLLV | 90.231 | 307. |
| 8 | 221 | LLILKTVLGL | 83.527 | 308. |
| 9 | 100 | LLQIFAIHSL | 83.527 | 309. |
| 10 | 139 | TLPRVTKIGV | 69.552 | 310. |
| 11 | 253 | YVPFIGLSMV | 64.388 | 311. |
| 12 | 94 | IQFDACLLQI | 62.741 | 312. |
| 13 | 245 | HVCAVFIFYV | 57.690 | 313. |
| 14 | 62 | YIFLCMLSGI | 56.155 | 314. |
| 15 | 64 | FLCMLSGIDI | 47.991 | 315. |
| 16 | 248 | AVFIFYVPFI | 42.727 | 316. |
| 17 | 137 | VLTLPRVTKI | 40.792 | 317. |
| 18 | 282 | LLVPPVLNPI | 40.792 | 318. |
| 19 | 37 | YLIAVLGNLT | 34.279 | 319. |
| 20 | 237 | KAFGTCVSHV | 28.772 | 320. |
| 21 | 66 | CMLSGIDILI | 27.879 | 321. |
| 22 | 234 | AQAKAFGTCV | 26.797 | 322. |
| 23 | 214 | LLISFSYLLI | 26.604 | 323. |
| 24 | 82 | KMLAIFWFNS | 26.114 | 324. |
| 25 | 83 | MLAIFWFNST | 24.070 | 325. |
| 26 | 21 | GLEEAQFWLA | 18.576 | 326. |
| 27 | 44 | NLTIIYIVRT | 17.140 | 327. |
| 28 | 218 | FSYLLILKTV | 15.371 | 328. |
| 29 | 303 | RILRLFHVAT | 14.407 | 329. |
| 30 | 142 | RVTKIGVAAV | 13.997 | 330. |
| 31 | 166 | KQLPFCRSNI | 13.698 | 331. |
| 32 | 181 | CLHQDVMKLA | 11.426 | 332. |
| 33 | 119 | AMAFDRYVAI | 11.302 | 333. |
| 34 | 29 | LAFPLCSLYL | 10.264 | 334. |
| 35 | 108 | SLSGMESTVL | 8.759 | 335. |
| 36 | 167 | QLPFCRSNIL | 8.759 | 336. |
| 37 | 227 | VLGLTREAQA | 8.446 | 337. |
| 38 | 301 | RQRILRLFHV | 7.149 | 338. |
| 39 | 189 | LACDDIRVNV | 6.733 | 339. |
| 40 | 205 | IISAIGLDSL | 5.628 | 340. |
| 41 | 180 | YCLHQDVMKL | 5.459 | 341. |
| 42 | 85 | AIFWFNSTTI | 5.308 | 342. |
| 43 | 242 | CVSHVCAVFI | 5.021 | 343. |
| 44 | 202 | LIVIISAIGL | 4.993 | 344. |
| 45 | 229 | GLTREAQAKA | 4.968 | 345. |
| 46 | 291 | IVYGVKTKEI | 4.966 | 346. |
| 47 | 215 | LISFSYLLIL | 4.709 | 347. |
| 48 | 159 | APLPVFIKQL | 4.510 | 348. |
| 49 | 283 | LVPPVLNPIV | 4.242 | 349. |
| 50 | 279 | NIYLLVPPVL | 3.854 | 350. |
| 51 | 25 | AQFWLAFPLC | 3.541 | 351. |
| 52 | 32 | PLCSLYLIAV | 3.519 | 352. |
| 53 | 298 | KEIRQRILRL | 3.344 | 353. |
| 54 | 74 | LISTSSMPKM | 2.671 | 354. |
| 55 | 200 | YGLIVIISAI | 2.666 | 355. |
| 56 | 195 | RVNVVYGLIV | 2.495 | 356. |
| 57 | 38 | LIAVLGNLTI | 2.439 | 357. |
| 58 | 240 | GTCVSHVCAV | 2.222 | 358. |
| 59 | 222 | LILKTVLGLT | 1.927 | 359. |
| 60 | 120 | MAFDRYVAIC | 1.678 | 360. |
| 61 | 20 | PGLEEAQFWL | 1.485 | 361. |
| 62 | 7 | NESSATYFIL | 1.482 | 362. |
| 63 | 16 | LIGLPGLEEA | 1.309 | 363. |
| 64 | 273 | LPVILANIYL | 1.304 | 364. |
| 65 | 220 | YLLILKTVLG | 1.268 | 365. |
| 66 | 286 | PVLNPIVYGV | 1.139 | 366. |
| 67 | 110 | SGMESTVLLA | 1.132 | 367. |
| 68 | 91 | STTIQFDACL | 1.127 | 368. |
| 69 | 99 | CLLQIFAIHS | 1.048 | 369. |
| 70 | 278 | ANIYLLVPPV | 1.044 | 370. |
| 71 | 127 | AICHPLRHAT | 1.025 | 371. |
| 72 | 154 | GAALMAPLPV | 0.966 | 372. |
| 73 | 89 | FNSTTIQFDA | 0.865 | 373. |

TABLE VIII-continued

HLA PEPTIDE SCORING RESULTS-101P3A11- A0201, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 74 | 197 | NVVYGLIVII | 0.861 | 374. |
| 75 | 232 | REAQAKAFGT | 0.840 | 375. |
| 76 | 128 | ICHPLRHATV | 0.772 | 376. |
| 77 | 42 | LGNLTIIYIV | 0.728 | 377. |
| 78 | 190 | ACDDIRVNVV | 0.702 | 378. |
| 79 | 10 | SATYFILIGL | 0.682 | 379. |
| 80 | 84 | LAIFWFNSTT | 0.669 | 380. |
| 81 | 187 | MKLACDDIRV | 0.608 | 381. |
| 82 | 281 | YLLVPPVLNP | 0.583 | 382. |
| 83 | 271 | SPLPVILANI | 0.580 | 383. |
| 84 | 35 | SLYLIAVLGN | 0.548 | 384. |
| 85 | 111 | GMESTVLLAM | 0.528 | 385. |
| 86 | 148 | VAAVVRGAAL | 0.504 | 386. |
| 87 | 162 | PVFIKQLPFC | 0.448 | 387. |
| 88 | 116 | VLLAMAFDRY | 0.436 | 388. |
| 89 | 150 | AVVRGAALMA | 0.435 | 389. |
| 90 | 65 | LCMLSGIDIL | 0.405 | 390. |
| 91 | 212 | DSLLISFSYL | 0.404 | 391. |
| 92 | 112 | MESTVLLAMA | 0.378 | 392. |
| 93 | 210 | GLDSLLISFS | 0.377 | 393. |
| 94 | 28 | WLAFPLCSLY | 0.343 | 394. |
| 95 | 31 | FPLCSLYLIA | 0.339 | 395. |
| 96 | 59 | EPMYIFLCML | 0.338 | 396. |
| 97 | 92 | TTIQFDACLL | 0.297 | 397. |
| 98 | 79 | SMPKMLAIFW | 0.296 | 398. |
| 99 | 306 | RLFHVATHAS | 0.276 | 399. |
| 100 | 109 | LSGMESTVLL | 0.237 | 400. |

TABLE IX

HLA PEPTIDE SCORING RESULTS-101P3A11- A3, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 1 | 229 | GLTREAQAK | 60.000 | 401. |
| 2 | 137 | VLTLPRVTK | 30.000 | 402. |
| 3 | 56 | SLHEPMYIF | 20.250 | 403. |
| 4 | 260 | SMVHRFSKR | 18.000 | 404. |
| 5 | 210 | GLDSLLISF | 18.000 | 405. |
| 6 | 116 | VLLAMAFDR | 18.000 | 406. |
| 7 | 44 | NLTIIYIVR | 12.000 | 407. |
| 8 | 117 | LLAMAFDRY | 12.000 | 408. |
| 9 | 21 | GLEEAQFWL | 8.100 | 409. |
| 10 | 214 | LLISFSYLL | 8.100 | 410. |
| 11 | 41 | VLGNLTIIY | 8.000 | 411. |
| 12 | 156 | ALMAPLPVF | 6.750 | 412. |
| 13 | 201 | GLIVIISAI | 6.075 | 413. |
| 14 | 287 | VLNPIVYGV | 4.050 | 414. |
| 15 | 74 | LISTSSMPK | 4.000 | 415. |
| 16 | 181 | CLHQDVMKL | 3.600 | 416. |
| 17 | 245 | HVCAVFIFY | 3.600 | 417. |
| 18 | 111 | GMESTVLLA | 3.600 | 418. |
| 19 | 79 | SMPKMLAIF | 3.000 | 419. |
| 20 | 248 | AVFIFYVPF | 3.000 | 420. |
| 21 | 158 | MAPLPVFIK | 2.700 | 421. |
| 22 | 213 | SLLISFSYL | 2.700 | 422. |
| 23 | 67 | MLSGIDILI | 2.700 | 423. |
| 24 | 306 | RLFHVATHA | 1.500 | 424. |
| 25 | 60 | PMYIFLCML | 1.350 | 425. |
| 26 | 28 | WLAFPLCSL | 1.350 | 426. |
| 27 | 99 | CLLQIFAIH | 1.350 | 427. |
| 28 | 66 | CMLSGIDIL | 1.350 | 428. |
| 29 | 82 | KMLAIFWFN | 1.215 | 429. |
| 30 | 145 | KIGVAAVVR | 1.200 | 430. |
| 31 | 188 | KLACDDIRV | 1.200 | 431. |
| 32 | 164 | FIKQLPFCR | 1.200 | 432. |
| 33 | 220 | YLLILKTVL | 0.900 | 433. |
| 34 | 157 | LMAPLPVFI | 0.900 | 434. |

TABLE IX-continued

HLA PEPTIDE SCORING RESULTS-101P3A11- A3, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ. ID# |
|---|---|---|---|---|
| 35 | 11 | ATYFILIGL | 0.675 | 435. |
| 36 | 198 | VVYGLIVII | 0.675 | 436. |
| 37 | 37 | YLIAVLGNL | 0.608 | 437. |
| 38 | 167 | QLPFCRSNI | 0.600 | 438. |
| 39 | 256 | FIGLSMVHR | 0.600 | 439. |
| 40 | 276 | ILANIYLLV | 0.600 | 440. |
| 41 | 119 | AMAFDRYVA | 0.600 | 441. |
| 42 | 186 | VMKLACDDI | 0.600 | 442. |
| 43 | 261 | MVHRFSKRR | 0.600 | 443. |
| 44 | 222 | LILKTVLGL | 0.540 | 444. |
| 45 | 259 | LSMVHRFSK | 0.450 | 445. |
| 46 | 290 | PIVYGVKTK | 0.450 | 446. |
| 47 | 282 | LLVPPVLNP | 0.405 | 447. |
| 48 | 275 | VILANIYLL | 0.405 | 448. |
| 49 | 125 | YVAICHPLR | 0.400 | 449. |
| 50 | 83 | MLAIFWFNS | 0.360 | 450. |
| 51 | 304 | ILRLFHVAT | 0.300 | 451. |
| 52 | 29 | LAFPLCSLY | 0.300 | 452. |
| 53 | 180 | YCLHQDVMK | 0.300 | 453. |
| 54 | 108 | SLSGMESTV | 0.300 | 454. |
| 55 | 242 | CVSHVCAVF | 0.300 | 455. |
| 56 | 279 | NIYLLVPPV | 0.300 | 456. |
| 57 | 114 | STVLLAMAF | 0.300 | 457. |
| 58 | 174 | NILSHSYCL | 0.270 | 458. |
| 59 | 25 | AQFWLAFPL | 0.270 | 459. |
| 60 | 197 | NVVYGLIVI | 0.270 | 460. |
| 61 | 100 | LLQIFAIHS | 0.240 | 461. |
| 62 | 296 | KTKEIRQRI | 0.203 | 462. |
| 63 | 138 | LTLPRVTKI | 0.203 | 463. |
| 64 | 40 | AVLGNLTII | 0.203 | 464. |
| 65 | 283 | LVPPVLNPI | 0.203 | 465. |
| 66 | 175 | ILSHSYCLH | 0.200 | 466. |
| 67 | 162 | PVFIKQLPF | 0.200 | 467. |
| 68 | 203 | IVIISAIGL | 0.180 | 468. |
| 69 | 85 | AIFWFNSTT | 0.150 | 469. |
| 70 | 35 | SLYLIAVLG | 0.150 | 470. |
| 71 | 47 | IIYIVRTEH | 0.150 | 471. |
| 72 | 14 | FILIGLPGL | 0.135 | 472. |
| 73 | 92 | TTIQFDACL | 0.135 | 473. |
| 74 | 272 | PLPVILANI | 0.135 | 474. |
| 75 | 216 | ISFSYLLIL | 0.135 | 475. |
| 76 | 160 | PLPVFIKQL | 0.135 | 476. |
| 77 | 208 | AIGLDSLLI | 0.120 | 477. |
| 78 | 215 | LISFSYLLI | 0.120 | 478. |
| 79 | 298 | KEIRQRILR | 0.108 | 479. |
| 80 | 18 | GLPGLEEAQ | 0.090 | 480. |
| 81 | 49 | YIVRTEHSL | 0.090 | 481. |
| 82 | 303 | RILRLFHVA | 0.090 | 482. |
| 83 | 134 | HATVLTLPR | 0.080 | 483. |
| 84 | 223 | ILKTVLGLT | 0.068 | 484. |
| 85 | 217 | SFSYLLILK | 0.060 | 485. |
| 86 | 253 | YVPFIGLSM | 0.060 | 486. |
| 87 | 273 | LPVILANIY | 0.060 | 487. |
| 88 | 93 | TIQFDACLL | 0.060 | 488. |
| 89 | 151 | VVRGAALMA | 0.060 | 489. |
| 90 | 9 | SSATYFILI | 0.054 | 490. |
| 91 | 299 | EIRQRILRL | 0.054 | 491. |
| 92 | 237 | KAFGTCVSH | 0.045 | 492. |
| 93 | 281 | YLLVPPVLN | 0.045 | 493. |
| 94 | 250 | FIFYVPFIG | 0.045 | 494. |
| 95 | 98 | ACLLQIFAI | 0.041 | 495. |
| 96 | 212 | DSLLISFSY | 0.041 | 496. |
| 97 | 31 | FPLCSLYLI | 0.041 | 497. |
| 98 | 101 | LQIFAIHSL | 0.041 | 498. |
| 99 | 32 | PLCSLYLIA | 0.040 | 499. |
| 100 | 45 | LTIIYIVRT | 0.034 | 500. |

TABLE X

HLA PEPTIDE SCORING RESULTS-101P3A11-A3, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 157 | LMAPLPVFIK | 405.000 | 501. |
| 2 | 258 | GLSMVHRFSK | 180.000 | 502. |
| 3 | 73 | ILISTSSMPK | 60.000 | 503. |
| 4 | 116 | VLLAMAFDRY | 18.000 | 504. |
| 5 | 287 | VLNPIVYGVK | 13.500 | 505. |
| 6 | 18 | GLPGLEEAQF | 9.000 | 506. |
| 7 | 260 | SMVHRFSKRR | 9.000 | 507. |
| 8 | 213 | SLLISFSYLL | 8.100 | 508. |
| 9 | 21 | GLEEAQFWLA | 8.100 | 509. |
| 10 | 223 | ILKTVLGLTR | 8.000 | 510. |
| 11 | 221 | LLILKTVLGL | 5.400 | 511. |
| 12 | 136 | TVLTLPRVTK | 4.500 | 512. |
| 13 | 28 | WLAFPLCSLY | 4.000 | 513. |
| 14 | 186 | VMKLACDDIR | 4.000 | 514. |
| 15 | 282 | LLVPPVLNPI | 3.038 | 515. |
| 16 | 66 | CMLSGIDILI | 2.700 | 516. |
| 17 | 248 | AVFIFYVPFI | 2.700 | 517. |
| 18 | 111 | GMESTVLLAM | 2.700 | 518. |
| 19 | 250 | FIFYVPFIGL | 2.700 | 519. |
| 20 | 115 | TVLLAMAFDR | 1.800 | 520. |
| 21 | 137 | VLTLPRVTKI | 1.800 | 521. |
| 22 | 40 | AVLGNLTIIY | 1.800 | 522. |
| 23 | 56 | SLHEPMYIFL | 1.800 | 523. |
| 24 | 214 | LLISFSYLLI | 1.800 | 524. |
| 25 | 41 | VLGNLTIIYI | 1.800 | 525. |
| 26 | 82 | KMLAIFWFNS | 1.620 | 526. |
| 27 | 216 | ISFSYLLILK | 1.500 | 527. |
| 28 | 64 | FLCMLSGIDI | 1.200 | 528. |
| 29 | 100 | LLQIFAIHSL | 0.900 | 529. |
| 30 | 108 | SLSGMESTVL | 0.900 | 530. |
| 31 | 156 | ALMAPLPVFI | 0.900 | 531. |
| 32 | 83 | MLAIFWFNST | 0.900 | 532. |
| 33 | 256 | FIGLSMVHRF | 0.600 | 533. |
| 34 | 304 | ILRLFHVATH | 0.600 | 534. |
| 35 | 119 | AMAFDRYVAI | 0.600 | 535. |
| 36 | 167 | QLPFCRSNIL | 0.600 | 536. |
| 37 | 35 | SLYLIAVLGN | 0.600 | 537. |
| 38 | 229 | GLTREAQAKA | 0.600 | 538. |
| 39 | 215 | LISFSYLLIL | 0.540 | 539. |
| 40 | 44 | NLTIIYIVRT | 0.450 | 540. |
| 41 | 279 | NIYLLVPPVL | 0.450 | 541. |
| 42 | 62 | YIFLCMLSGI | 0.450 | 542. |
| 43 | 289 | NPIVYGVKTK | 0.450 | 543. |
| 44 | 139 | TLPRVTKIGV | 0.400 | 544. |
| 45 | 79 | SMPKMLAIFW | 0.400 | 545. |
| 46 | 272 | PLPVILANIY | 0.400 | 546. |
| 47 | 131 | PLRHATVLTL | 0.360 | 547. |
| 48 | 99 | CLLQIFAIHS | 0.360 | 548. |
| 49 | 85 | AIFWFNSTTI | 0.300 | 549. |
| 50 | 94 | IQFDACLLQI | 0.270 | 550. |
| 51 | 281 | YLLVPPVLNP | 0.270 | 551. |
| 52 | 198 | VVYGLIVIIS | 0.270 | 552. |
| 53 | 245 | HVCAVFIFYV | 0.270 | 553. |
| 54 | 193 | DIRVNVVYGL | 0.243 | 554. |
| 55 | 181 | CLHQDVMKLA | 0.225 | 555. |
| 56 | 291 | IVYGVKTKEI | 0.225 | 556. |
| 57 | 306 | RLFHVATHAS | 0.200 | 557. |
| 58 | 227 | VLGLTREAQA | 0.200 | 558. |
| 59 | 32 | PLCSLYLIAV | 0.180 | 559. |
| 60 | 294 | GVKTKEIRQR | 0.180 | 560. |
| 61 | 210 | GLDSLLISFS | 0.180 | 561. |
| 62 | 202 | LIVIISAIGL | 0.180 | 562. |
| 63 | 67 | MLSGIDILIS | 0.180 | 563. |
| 64 | 276 | ILANIYLLVP | 0.180 | 564. |
| 65 | 37 | YLIAVLGNLT | 0.150 | 565. |
| 66 | 15 | ILIGLPGLEE | 0.135 | 566. |
| 67 | 197 | NVVYGLIVII | 0.135 | 567. |
| 68 | 237 | KAFGTCVSHV | 0.135 | 568. |
| 69 | 201 | GLIVIISAIG | 0.135 | 569. |
| 70 | 166 | KQLPFCRSNI | 0.121 | 570. |
| 71 | 175 | ILSHSYCLHQ | 0.120 | 571. |
| 72 | 195 | RVNVVYGLIV | 0.120 | 572. |
| 73 | 38 | LIAVLGNLTI | 0.120 | 573. |

TABLE X-continued

HLA PEPTIDE SCORING RESULTS-101P3A11-A3, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 74 | 43 | GNLTIIYIVR | 0.108 | 574. |
| 75 | 55 | HSLHEPMYIF | 0.101 | 575. |
| 76 | 25 | AQFWLAFPLC | 0.090 | 576. |
| 77 | 240 | GTCVSHVCAV | 0.090 | 577. |
| 78 | 29 | LAFPLCSLYL | 0.090 | 578. |
| 79 | 259 | LSMVHRFSKR | 0.090 | 579. |
| 80 | 275 | VILANIYLLV | 0.090 | 580. |
| 81 | 120 | MAFDRYVAIC | 0.090 | 581. |
| 82 | 243 | VSHVCAVFIF | 0.090 | 582. |
| 83 | 91 | STTIQFDACL | 0.090 | 583. |
| 84 | 247 | CAVFIFYVPF | 0.090 | 584. |
| 85 | 205 | IISAIGLDSL | 0.090 | 585. |
| 86 | 80 | MPKMLAIFWF | 0.090 | 586. |
| 87 | 284 | VPPVLNPIVY | 0.080 | 587. |
| 88 | 230 | LTREAQAKAF | 0.075 | 588. |
| 89 | 155 | AALMAPLPVF | 0.068 | 589. |
| 90 | 242 | CVSHVCAVFI | 0.060 | 590. |
| 91 | 161 | LPVFIKQLPF | 0.060 | 591. |
| 92 | 117 | LLAMAFDRYV | 0.060 | 592. |
| 93 | 150 | AVVRGAALMA | 0.060 | 593. |
| 94 | 142 | RVTKIGVAAV | 0.060 | 594. |
| 95 | 244 | SHVCAVFIFY | 0.054 | 595. |
| 96 | 180 | YCLHQDVMKL | 0.054 | 596. |
| 97 | 46 | TIIYIVRTEH | 0.045 | 597. |
| 98 | 241 | TCVSHVCAVF | 0.045 | 598. |
| 99 | 92 | TTIQFDACLL | 0.045 | 599. |
| 100 | 303 | RILRLFHVAT | 0.045 | 600. |

TABLE XI

HLA PEPTIDE SCORING RESULTS-101P3A11-A1101, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 229 | GLTREAQAK | 1.200 | 601. |
| 2 | 74 | LISTSSMPK | 0.800 | 602. |
| 3 | 158 | MAPLPVFIK | 0.600 | 603. |
| 4 | 217 | SFSYLLILK | 0.400 | 604. |
| 5 | 125 | YVAICHPLR | 0.400 | 605. |
| 6 | 137 | VLTLPRVTK | 0.400 | 606. |
| 7 | 116 | VLLAMAFDR | 0.360 | 607. |
| 8 | 180 | YCLHQDVMK | 0.300 | 608. |
| 9 | 145 | KIGVAAVVR | 0.240 | 609. |
| 10 | 164 | FIKQLPFCR | 0.240 | 610. |
| 11 | 261 | MVHRFSKRR | 0.200 | 611. |
| 12 | 44 | NLTIIYIVR | 0.160 | 612. |
| 13 | 259 | LSMVHRFSK | 0.120 | 613. |
| 14 | 260 | SMVHRFSKR | 0.120 | 614. |
| 15 | 298 | KEIRQRILR | 0.108 | 615. |
| 16 | 256 | FIGLSMVHR | 0.080 | 616. |
| 17 | 134 | HATVLTLPR | 0.080 | 617. |
| 18 | 142 | RVTKIGVAA | 0.060 | 618. |
| 19 | 197 | NVVYGLIVI | 0.060 | 619. |
| 20 | 203 | IVIISAIGL | 0.060 | 620. |
| 21 | 195 | RVNVVYGLI | 0.060 | 621. |
| 22 | 151 | VVRGAALMA | 0.040 | 622. |
| 23 | 245 | HVCAVFIFY | 0.040 | 623. |
| 24 | 11 | ATYFILIGL | 0.040 | 624. |
| 25 | 198 | VVYGLIVII | 0.040 | 625. |
| 26 | 248 | AVFIFYVPF | 0.040 | 626. |
| 27 | 288 | LNPIVYGVK | 0.040 | 627. |
| 28 | 253 | YVPFIGLSM | 0.040 | 628. |
| 29 | 301 | RQRILRLFH | 0.036 | 629. |
| 30 | 21 | GLEEAQFWL | 0.036 | 630. |
| 31 | 25 | AQFWLAFPL | 0.036 | 631. |
| 32 | 290 | PIVYGVKTK | 0.030 | 632. |
| 33 | 240 | GTCVSHVCA | 0.030 | 633. |
| 34 | 296 | KTKEIRQRI | 0.030 | 634. |

TABLE XI-continued

HLA PEPTIDE SCORING RESULTS-101P3A11-A1101, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 35 | 40 | AVLGNLTII | 0.030 | 635. |
| 36 | 150 | AVVRGAALM | 0.030 | 636. |
| 37 | 114 | STVLLAMAF | 0.030 | 637. |
| 38 | 306 | RLFHVATHA | 0.024 | 638. |
| 39 | 188 | KLACDDIRV | 0.024 | 639. |
| 40 | 210 | GLDSLLISF | 0.024 | 640. |
| 41 | 111 | GMESTVLLA | 0.024 | 641. |
| 42 | 50 | IVRTEHSLH | 0.020 | 642. |
| 43 | 242 | CVSHVCAVF | 0.020 | 643. |
| 44 | 283 | LVPPVLNPI | 0.020 | 644. |
| 45 | 303 | RILRLFHVA | 0.018 | 645. |
| 46 | 124 | RYVAICHPL | 0.018 | 646. |
| 47 | 201 | GLIVIISAI | 0.018 | 647. |
| 48 | 92 | TTIQFDACL | 0.015 | 648. |
| 49 | 135 | ATVLTLPRV | 0.015 | 649. |
| 50 | 138 | LTLPRVTKI | 0.015 | 650. |
| 51 | 237 | KAFGTCVSH | 0.012 | 651. |
| 52 | 174 | NILSHSYCL | 0.012 | 652. |
| 53 | 214 | LLISFSYLL | 0.012 | 653. |
| 54 | 275 | VILANIYLL | 0.012 | 654. |
| 55 | 222 | LILKTVLGL | 0.012 | 655. |
| 56 | 294 | GVKTKEIRQ | 0.012 | 656. |
| 57 | 143 | VTKIGVAAV | 0.010 | 657. |
| 58 | 230 | LTREAQAKA | 0.010 | 658. |
| 59 | 101 | LQIFAIHSL | 0.009 | 659. |
| 60 | 98 | ACLLQIFAI | 0.009 | 660. |
| 61 | 47 | IIYIVRTEH | 0.008 | 661. |
| 62 | 279 | NIYLLVPPV | 0.008 | 662. |
| 63 | 56 | SLHEPMYIF | 0.008 | 663. |
| 64 | 65 | LCMLSGIDI | 0.008 | 664. |
| 65 | 67 | MLSGIDILI | 0.008 | 665. |
| 66 | 208 | AIGLDSLLI | 0.008 | 666. |
| 67 | 224 | LKTVLGLTR | 0.008 | 667. |
| 68 | 181 | CLHQDVMKL | 0.008 | 668. |
| 69 | 276 | ILANIYLLV | 0.008 | 669. |
| 70 | 287 | VLNPIVYGV | 0.008 | 670. |
| 71 | 156 | ALMAPLPVF | 0.008 | 671. |
| 72 | 215 | LISFSYLLI | 0.008 | 672. |
| 73 | 251 | IFYVPFIGL | 0.008 | 673. |
| 74 | 119 | AMAFDRYVA | 0.008 | 674. |
| 75 | 41 | VLGNLTIIY | 0.008 | 675. |
| 76 | 162 | PVFIKQLPF | 0.008 | 676. |
| 77 | 187 | MKLACDDIR | 0.006 | 677. |
| 78 | 293 | YGVKTKEIR | 0.006 | 678. |
| 79 | 213 | SLLISFSYL | 0.006 | 679. |
| 80 | 147 | GVAAVVRGA | 0.006 | 680. |
| 81 | 39 | IAVLGNLTI | 0.006 | 681. |
| 82 | 220 | YLLILKTVL | 0.006 | 682. |
| 83 | 155 | AALMAPLPV | 0.006 | 683. |
| 84 | 274 | PVILANIYL | 0.006 | 684. |
| 85 | 66 | CMLSGIDIL | 0.006 | 685. |
| 86 | 31 | FPLCSLYLI | 0.006 | 686. |
| 87 | 126 | VAICHPLRH | 0.006 | 687. |
| 88 | 14 | FILIGLPGL | 0.006 | 688. |
| 89 | 37 | YLIAVLGNL | 0.006 | 689. |
| 90 | 99 | CLLQIFAIH | 0.006 | 690. |
| 91 | 280 | IYLLVPPVL | 0.006 | 691. |
| 92 | 49 | YIVRTEHSL | 0.006 | 692. |
| 93 | 246 | VCAVFIFYV | 0.006 | 693. |
| 94 | 76 | STSSMPKML | 0.005 | 694. |
| 95 | 225 | KTVLGLTRE | 0.005 | 695. |
| 96 | 179 | SYCLHQDVM | 0.004 | 696. |
| 97 | 29 | LAFPLCSLY | 0.004 | 697. |
| 98 | 167 | QLPFCRSNI | 0.004 | 698. |
| 99 | 28 | WLAFPLCSL | 0.004 | 699. |
| 100 | 117 | LLAMAFDRY | 0.004 | 700. |

TABLE XII

HLA PEPTIDE SCORING RESULTS-101P3A11-A-1101, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 258 | GLSMVHRFSK | 3.600 | 701. |
| 2 | 136 | TVLTLPRVTK | 3.000 | 702. |
| 3 | 115 | TVLLAMAFDR | 1.800 | 703. |
| 4 | 157 | LMAPLPVFIK | 1.200 | 704. |
| 5 | 73 | ILISTSSMPK | 1.200 | 705. |
| 6 | 287 | VLNPIVYGVK | 0.400 | 706. |
| 7 | 179 | SYCLHQDVMK | 0.400 | 707. |
| 8 | 124 | RYVAICHPLR | 0.360 | 708. |
| 9 | 163 | VFIKQLPFCR | 0.180 | 709. |
| 10 | 223 | ILKTVLGLTR | 0.160 | 710. |
| 11 | 289 | NPIVYGVKTK | 0.150 | 711. |
| 12 | 294 | GVKTKEIRQR | 0.120 | 712. |
| 13 | 195 | RVNVVYGLIV | 0.120 | 713. |
| 14 | 292 | VYGVKTKEIR | 0.080 | 714. |
| 15 | 216 | ISFSYLLILK | 0.080 | 715. |
| 16 | 186 | VMKLACDDIR | 0.080 | 716. |
| 17 | 43 | GNLTIIYIVR | 0.072 | 717. |
| 18 | 147 | GVAAVVRGAA | 0.060 | 718. |
| 19 | 245 | HVCAVFIFYV | 0.060 | 719. |
| 20 | 142 | RVTKIGVAAV | 0.060 | 720. |
| 21 | 150 | AVVRGAALMA | 0.060 | 721. |
| 22 | 40 | AVLGNLTIIY | 0.060 | 722. |
| 23 | 260 | SMVHRFSKRR | 0.060 | 723. |
| 24 | 301 | RQRILRLFHV | 0.054 | 724. |
| 25 | 248 | AVFIFYVPFI | 0.040 | 725. |
| 26 | 125 | YVAICHPLRH | 0.040 | 726. |
| 27 | 228 | LGLTREAQAK | 0.030 | 727. |
| 28 | 52 | RTEHSLHEPM | 0.030 | 728. |
| 29 | 240 | GTCVSHVCAV | 0.030 | 729. |
| 30 | 197 | NVVYGLIVII | 0.030 | 730. |
| 31 | 166 | KQLPFCRSNI | 0.027 | 731. |
| 32 | 133 | RHATVLTLPR | 0.024 | 732. |
| 33 | 94 | IQFDACLLQI | 0.024 | 733. |
| 34 | 111 | GMESTVLLAM | 0.024 | 734. |
| 35 | 21 | GLEEAQFWLA | 0.024 | 735. |
| 36 | 291 | IVYGVKTKEI | 0.020 | 736. |
| 37 | 242 | CVSHVCAVFI | 0.020 | 737. |
| 38 | 253 | YVPFIGLSMV | 0.020 | 738. |
| 39 | 76 | STSSMPKMLA | 0.020 | 739. |
| 40 | 283 | LVPPVLNPIV | 0.020 | 740. |
| 41 | 250 | FIFYVPFIGL | 0.016 | 741. |
| 42 | 92 | TTIQFDACLL | 0.015 | 742. |
| 43 | 202 | LIVIISAIGL | 0.012 | 743. |
| 44 | 275 | VILANIYLLV | 0.012 | 744. |
| 45 | 221 | LLILKTVLGL | 0.012 | 745. |
| 46 | 229 | GLTREAQAKA | 0.012 | 746. |
| 47 | 214 | LLISFSYLLI | 0.012 | 747. |
| 48 | 18 | GLPGLEEAQF | 0.012 | 748. |
| 49 | 154 | GAALMAPLPV | 0.012 | 749. |
| 50 | 66 | CMLSGIDILI | 0.012 | 750. |
| 51 | 213 | SLLISFSYLL | 0.012 | 751. |
| 52 | 252 | FYVPFIGLSM | 0.012 | 752. |
| 53 | 237 | KAFGTCVSHV | 0.012 | 753. |
| 54 | 185 | DVMKLACDDI | 0.012 | 754. |
| 55 | 91 | STTIQFDACL | 0.010 | 755. |
| 56 | 143 | VTKIGVAAVV | 0.010 | 756. |
| 57 | 56 | SLHEPMYIFL | 0.008 | 757. |
| 58 | 79 | SMPKMLAIFW | 0.008 | 758. |
| 59 | 297 | TKEIRQRILR | 0.008 | 759. |
| 60 | 41 | VLGNLTIIYI | 0.008 | 760. |
| 61 | 118 | LAMAFDRYVA | 0.008 | 761. |
| 62 | 62 | YIFLCMLSGI | 0.008 | 762. |
| 63 | 215 | LISFSYLLIL | 0.008 | 763. |
| 64 | 64 | FLCMLSGIDI | 0.008 | 764. |
| 65 | 199 | VYGLIVIISA | 0.008 | 765. |
| 66 | 156 | ALMAPLPVFI | 0.008 | 766. |
| 67 | 139 | TLPRVTKIGV | 0.008 | 767. |
| 68 | 85 | AIFWFNSTTI | 0.008 | 768. |
| 69 | 38 | LIAVLGNLTI | 0.008 | 769. |
| 70 | 254 | VPFIGLSMVH | 0.008 | 770. |
| 71 | 29 | LAFPLCSLYL | 0.008 | 771. |
| 72 | 259 | LSMVHRFSKR | 0.008 | 772. |
| 73 | 198 | VVYGLIVIIS | 0.008 | 773. |

TABLE XII-continued

HLA PEPTIDE SCORING RESULTS-101P3A11-A-1101, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 74 | 279 | NIYLLVPPVL | 0.008 | 774. |
| 75 | 144 | TKIGVAAVVR | 0.006 | 775. |
| 76 | 255 | PFIGLSMVHR | 0.006 | 776. |
| 77 | 207 | SAIGLDSLLI | 0.006 | 777. |
| 78 | 36 | LYLIAVLGNL | 0.006 | 778. |
| 79 | 46 | TIIYIVRTEH | 0.006 | 779. |
| 80 | 286 | PVLNPIVYGV | 0.006 | 780. |
| 81 | 49 | YIVRTEHSLH | 0.006 | 781. |
| 82 | 80 | MPKMLAIFWF | 0.006 | 782. |
| 83 | 161 | LPVFIKQLPF | 0.006 | 783. |
| 84 | 264 | RFSKRRDSPL | 0.006 | 784. |
| 85 | 174 | NILSHSYCLH | 0.006 | 785. |
| 86 | 116 | VLLAMAFDRY | 0.006 | 786. |
| 87 | 219 | SYLLILKTVL | 0.006 | 787. |
| 88 | 180 | YCLHQDVMKL | 0.006 | 788. |
| 89 | 31 | FPLCSLYLIA | 0.006 | 789. |
| 90 | 48 | IYIVRTEHSL | 0.006 | 790. |
| 91 | 274 | PVILANIYLL | 0.006 | 791. |
| 92 | 273 | LPVILANIYL | 0.006 | 792. |
| 93 | 282 | LLVPPVLNPI | 0.006 | 793. |
| 94 | 234 | AQAKAFGTCV | 0.006 | 794. |
| 95 | 82 | KMLAIFWFNS | 0.005 | 795. |
| 96 | 298 | KEIRQRILRL | 0.005 | 796. |
| 97 | 230 | LTREAQAKAF | 0.005 | 797. |
| 98 | 225 | KTVLGLTREA | 0.005 | 798. |
| 99 | 108 | SLSGMESTVL | 0.004 | 799. |
| 100 | 10 | SATYFILIGL | 0.004 | 800. |

TABLE XIII

HLA PEPTIDE SCORING RESULTS-101P3A11-A24, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 124 | RYVAICHPL | 840.000 | 801. |
| 2 | 280 | IYLLVPPVL | 420.000 | 802. |
| 3 | 292 | VYGVKTKEI | 55.000 | 803. |
| 4 | 30 | AFPLCSLYL | 30.000 | 804. |
| 5 | 179 | SYCLHQDVM | 25.000 | 805. |
| 6 | 251 | IFYVPFIGL | 24.000 | 806. |
| 7 | 88 | WFNSTTIQF | 15.000 | 807. |
| 8 | 219 | SYLLILKTV | 10.500 | 808. |
| 9 | 153 | RGAALMAPL | 9.600 | 809. |
| 10 | 252 | FYVPFIGLS | 9.000 | 810. |
| 11 | 61 | MYIFLCMLS | 9.000 | 811. |
| 12 | 37 | YLIAVLGNL | 8.400 | 812. |
| 13 | 36 | LYLIAVLGN | 7.500 | 813. |
| 14 | 249 | VFIFYVPFI | 7.500 | 814. |
| 15 | 63 | IFLCMLSGI | 7.500 | 815. |
| 16 | 48 | IYIVRTEHS | 7.500 | 816. |
| 17 | 213 | SLLISFSYL | 7.200 | 817. |
| 18 | 207 | SAIGLDSLL | 7.200 | 818. |
| 19 | 220 | YLLILKTVL | 7.200 | 819. |
| 20 | 34 | CSLYLIAVL | 7.200 | 820. |
| 21 | 21 | GLEEAQFWL | 7.200 | 821. |
| 22 | 110 | SGMESTVLL | 7.200 | 822. |
| 23 | 199 | VYGLIVIIS | 7.000 | 823. |
| 24 | 92 | TTIQFDACL | 6.000 | 824. |
| 25 | 66 | CMLSGIDIL | 6.000 | 825. |
| 26 | 174 | NILSHSYCL | 6.000 | 826. |
| 27 | 49 | YIVRTEHSL | 6.000 | 827. |
| 28 | 275 | VILANIYLL | 6.000 | 828. |
| 29 | 149 | AAVVRGAAL | 6.000 | 829. |
| 30 | 101 | LQIFAIHSL | 6.000 | 830. |
| 31 | 222 | LILKTVLGL | 6.000 | 831. |
| 32 | 130 | HPLRHATVL | 6.000 | 832. |
| 33 | 214 | LLISFSYLL | 6.000 | 833. |
| 34 | 93 | TIQFDACLL | 6.000 | 834. |

TABLE XIII-continued

HLA PEPTIDE SCORING RESULTS-101P3A11-A24, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 35 | 14 | FILIGLPGL | 6.000 | 835. |
| 36 | 203 | IVIISAIGL | 6.000 | 836. |
| 37 | 11 | ATYFILIGL | 5.600 | 837. |
| 38 | 86 | IFWFNSTTI | 5.000 | 838. |
| 39 | 95 | QFDACLLQI | 5.000 | 839. |
| 40 | 25 | AQFWLAFPL | 4.800 | 840. |
| 41 | 168 | LPFCRSNIL | 4.800 | 841. |
| 42 | 181 | CLHQDVMKL | 4.400 | 842. |
| 43 | 195 | RVNVVYGLI | 4.200 | 843. |
| 44 | 296 | KTKEIRQRI | 4.032 | 844. |
| 45 | 265 | FSKRRDSPL | 4.000 | 845. |
| 46 | 206 | ISAIGLDSL | 4.000 | 846. |
| 47 | 216 | ISFSYLLIL | 4.000 | 847. |
| 48 | 28 | WLAFPLCSL | 4.000 | 848. |
| 49 | 76 | STSSMPKML | 4.000 | 849. |
| 50 | 8 | ESSATYFIL | 4.000 | 850. |
| 51 | 109 | LSGMESTVL | 4.000 | 851. |
| 52 | 299 | EIRQRILRL | 4.000 | 852. |
| 53 | 114 | STVLLAMAF | 3.600 | 853. |
| 54 | 283 | LVPPVLNPI | 3.024 | 854. |
| 55 | 156 | ALMAPLPVF | 3.000 | 855. |
| 56 | 257 | IGLSMVHRF | 3.000 | 856. |
| 57 | 6 | GNESSATYF | 3.000 | 857. |
| 58 | 79 | SMPKMLAIF | 3.000 | 858. |
| 59 | 242 | CVSHVCAVF | 2.800 | 859. |
| 60 | 210 | GLDSLLISF | 2.400 | 860. |
| 61 | 56 | SLHEPMYIF | 2.400 | 861. |
| 62 | 201 | GLIVIISAI | 2.100 | 862. |
| 63 | 19 | LPGLEEAQF | 2.000 | 863. |
| 64 | 248 | AVFIFYVPF | 2.000 | 864. |
| 65 | 138 | LTLPRVTKI | 1.980 | 865. |
| 66 | 78 | SSMPKMLAI | 1.800 | 866. |
| 67 | 197 | NVVYGLIVI | 1.500 | 867. |
| 68 | 98 | ACLLQIFAI | 1.500 | 868. |
| 69 | 42 | LGNLTIIYI | 1.500 | 869. |
| 70 | 55 | HSLHEPMYI | 1.500 | 870. |
| 71 | 65 | LCMLSGIDI | 1.500 | 871. |
| 72 | 39 | IAVLGNLTI | 1.500 | 872. |
| 73 | 167 | QLPFCRSNI | 1.500 | 873. |
| 74 | 40 | AVLGNLTII | 1.500 | 874. |
| 75 | 31 | FPLCSLYLI | 1.500 | 875. |
| 76 | 157 | LMAPLPVFI | 1.440 | 876. |
| 77 | 67 | MLSGIDILI | 1.400 | 877. |
| 78 | 59 | EPMYIFLCM | 1.260 | 878. |
| 79 | 120 | MAFDRYVAI | 1.200 | 879. |
| 80 | 9 | SSATYFILI | 1.200 | 880. |
| 81 | 198 | VVYGLIVII | 1.200 | 881. |
| 82 | 269 | RDSPLPVIL | 1.152 | 882. |
| 83 | 253 | YVPFIGLSM | 1.050 | 883. |
| 84 | 243 | VSHVCAVFI | 1.000 | 884. |
| 85 | 208 | AIGLDSLLI | 1.000 | 885. |
| 86 | 186 | VMKLACDDI | 1.000 | 886. |
| 87 | 215 | LISFSYLLI | 1.000 | 887. |
| 88 | 194 | IRVNVVYGL | 0.840 | 888. |
| 89 | 72 | DILISTSSM | 0.750 | 889. |
| 90 | 163 | VFIKQLPFC | 0.750 | 890. |
| 91 | 104 | FAIHSLSGM | 0.750 | 891. |
| 92 | 150 | AVVRGAALM | 0.750 | 892. |
| 93 | 57 | LHEPMYIFL | 0.720 | 893. |
| 94 | 12 | TYFILIGLP | 0.600 | 894. |
| 95 | 160 | PLPVFIKQL | 0.600 | 895. |
| 96 | 26 | QFWLAFPLC | 0.600 | 896. |
| 97 | 297 | TKEIRQRIL | 0.600 | 897. |
| 98 | 274 | PVILANIYL | 0.600 | 898. |
| 99 | 75 | ISTSSMPKM | 0.550 | 899. |
| 100 | 82 | KMLAIFWFN | 0.504 | 900. |

TABLE XIV

HLA PEPTIDE SCORING RESULTS-101P3A11-A24, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 36 | LYLIAVLGNL | 420.000 | 901. |
| 2 | 219 | SYLLILKTVL | 360.000 | 902. |
| 3 | 48 | IYIVRTEHSL | 300.000 | 903. |
| 4 | 252 | FYVPFIGLSM | 63.000 | 904. |
| 5 | 264 | RFSKRRDSPL | 40.000 | 905. |
| 6 | 13 | YFILIGLPGL | 30.000 | 906. |
| 7 | 95 | QFDACLLQIF | 14.400 | 907. |
| 8 | 296 | KTKEIRQRIL | 9.600 | 908. |
| 9 | 30 | AFPLCSLYLI | 7.500 | 909. |
| 10 | 280 | IYLLVPPVLN | 7.500 | 910. |
| 11 | 24 | EAQFWLAFPL | 7.200 | 911. |
| 12 | 167 | QLPFCRSNIL | 7.200 | 912. |
| 13 | 159 | APLPVFIKQL | 7.200 | 913. |
| 14 | 212 | DSLLISFSYL | 7.200 | 914. |
| 15 | 199 | VYGLIVIISA | 7.000 | 915. |
| 16 | 180 | YCLHQDVMKL | 6.600 | 916. |
| 17 | 65 | LCMLSGIDIL | 6.000 | 917. |
| 18 | 92 | TTIQFDACLL | 6.000 | 918. |
| 19 | 27 | FWLAFPLCSL | 6.000 | 919. |
| 20 | 213 | SLLISFSYLL | 6.000 | 920. |
| 21 | 59 | EPMYIFLCML | 6.000 | 921. |
| 22 | 273 | LPVILANIYL | 6.000 | 922. |
| 23 | 221 | LLILKTVLGL | 6.000 | 923. |
| 24 | 202 | LIVIISAIGL | 6.000 | 924. |
| 25 | 173 | SNILSHSYCL | 6.000 | 925. |
| 26 | 100 | LLQIFAIHSL | 6.000 | 926. |
| 27 | 279 | NIYLLVPPVL | 5.600 | 927. |
| 28 | 193 | DIRVNVVYGL | 5.600 | 928. |
| 29 | 10 | SATYFILIGL | 5.600 | 929. |
| 30 | 250 | FIFYVPFIGL | 4.800 | 930. |
| 31 | 29 | LAFPLCSLYL | 4.800 | 931. |
| 32 | 56 | SLHEPMYIFL | 4.800 | 932. |
| 33 | 33 | LCSLYLIAVL | 4.800 | 933. |
| 34 | 206 | ISAIGLDSLL | 4.800 | 934. |
| 35 | 209 | IGLDSLLISF | 4.320 | 935. |
| 36 | 241 | TCVSHVCAVF | 4.200 | 936. |
| 37 | 215 | LISFSYLLIL | 4.000 | 937. |
| 38 | 108 | SLSGMESTVL | 4.000 | 938. |
| 39 | 148 | VAAVVRGAAL | 4.000 | 939. |
| 40 | 205 | IISAIGLDSL | 4.000 | 940. |
| 41 | 91 | STTIQFDACL | 4.000 | 941. |
| 42 | 75 | ISTSSMPKML | 4.000 | 942. |
| 43 | 109 | LSGMESTVLL | 4.000 | 943. |
| 44 | 166 | KQLPFCRSNI | 3.600 | 944. |
| 45 | 78 | SSMPKMLAIF | 3.600 | 945. |
| 46 | 5 | NGNESSATYF | 3.600 | 946. |
| 47 | 282 | LLVPPVLNPI | 3.024 | 947. |
| 48 | 55 | HSLHEPMYIF | 3.000 | 948. |
| 49 | 161 | LPVFIKQLPF | 3.000 | 949. |
| 50 | 155 | AALMAPLPVF | 3.000 | 950. |
| 51 | 247 | CAVFIFYVPF | 3.000 | 951. |
| 52 | 18 | GLPGLEEAQF | 3.000 | 952. |
| 53 | 299 | EIRQRILRLF | 2.800 | 953. |
| 54 | 271 | SPLPVILANI | 2.520 | 954. |
| 55 | 103 | IFAIHSLSGM | 2.500 | 955. |
| 56 | 230 | LTREAQAKAF | 2.400 | 956. |
| 57 | 113 | ESTVLLAMAF | 2.400 | 957. |
| 58 | 66 | CMLSGIDILI | 2.100 | 958. |
| 59 | 200 | YGLIVIISAI | 2.100 | 959. |
| 60 | 256 | FIGLSMVHRF | 2.000 | 960. |
| 61 | 243 | VSHVCAVFIF | 2.000 | 961. |
| 62 | 87 | FWFNSTTIQF | 2.000 | 962. |
| 63 | 80 | MPKMLAIFWF | 2.000 | 963. |
| 64 | 156 | ALMAPLPVFI | 1.800 | 964. |
| 65 | 52 | RTEHSLHEPM | 1.800 | 965. |
| 66 | 197 | NVVYGLIVII | 1.800 | 966. |
| 67 | 6 | GNESSATYFI | 1.500 | 967. |
| 68 | 124 | RYVAICHPLR | 1.500 | 968. |
| 69 | 214 | LLISFSYLLI | 1.500 | 969. |
| 70 | 207 | SAIGLDSLLI | 1.500 | 970. |
| 71 | 196 | VNVVYGLIVI | 1.500 | 971. |
| 72 | 185 | DVMKLACDDI | 1.500 | 972. |
| 73 | 39 | IAVLGNLTII | 1.500 | 973. |

TABLE XIV-continued

HLA PEPTIDE SCORING RESULTS-101P3A11-A24, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 74 | 94 | IQFDACLLQI | 1.200 | 974. |
| 75 | 298 | KEIRQRILRL | 1.200 | 975. |
| 76 | 8 | ESSATYFILI | 1.200 | 976. |
| 77 | 291 | IVYGVKTKEI | 1.100 | 977. |
| 78 | 137 | VLTLPRVTKI | 1.100 | 978. |
| 79 | 111 | GMESTVLLAM | 1.050 | 979. |
| 80 | 85 | AIFWFNSTTI | 1.000 | 980. |
| 81 | 41 | VLGNLTIIYI | 1.000 | 981. |
| 82 | 97 | DACLLQIFAI | 1.000 | 982. |
| 83 | 119 | AMAFDRYVAI | 1.000 | 983. |
| 84 | 77 | TSSMPKMLAI | 1.000 | 984. |
| 85 | 38 | LIAVLGNLTI | 1.000 | 985. |
| 86 | 248 | AVFIFYVPFI | 1.000 | 986. |
| 87 | 64 | FLCMLSGIDI | 1.000 | 987. |
| 88 | 62 | YIFLCMLSGI | 1.000 | 988. |
| 89 | 242 | CVSHVCAVFI | 1.000 | 989. |
| 90 | 268 | RRDSPLPVIL | 0.960 | 990. |
| 91 | 61 | MYIFLCMLSG | 0.750 | 991. |
| 92 | 149 | AAVVRGAALM | 0.750 | 992. |
| 93 | 20 | PGLEEAQFWL | 0.720 | 993. |
| 94 | 12 | TYFILIGLPG | 0.700 | 994. |
| 95 | 238 | AFGTCVSHVC | 0.700 | 995. |
| 96 | 217 | SFSYLLILKT | 0.660 | 996. |
| 97 | 129 | CHPLRHATVL | 0.600 | 997. |
| 98 | 274 | PVILANIYLL | 0.600 | 998. |
| 99 | 123 | DRYVAICHPL | 0.560 | 999. |
| 100 | 74 | LISTSSMPKM | 0.550 | 1000. |

TABLE XV

HLA PEPTIDE SCORING RESULTS-101P3A11-B7, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 130 | HPLRHATVL | 80.000 | 1001. |
| 2 | 168 | LPFCRSNIL | 80.000 | 1002. |
| 3 | 59 | EPMYIFLCM | 60.000 | 1003. |
| 4 | 299 | EIRQRILRL | 40.000 | 1004. |
| 5 | 140 | LPRVTKIGV | 40.000 | 1005. |
| 6 | 149 | AAVVRGAAL | 36.000 | 1006. |
| 7 | 203 | IVIISAIGL | 20.000 | 1007. |
| 8 | 150 | AVVRGAALM | 15.000 | 1008. |
| 9 | 110 | SGMESTVLL | 12.000 | 1009. |
| 10 | 11 | ATYFILIGL | 12.000 | 1010. |
| 11 | 25 | AQFWLAFPL | 12.000 | 1011. |
| 12 | 207 | SAIGLDSLL | 12.000 | 1012. |
| 13 | 31 | FPLCSLYLI | 8.000 | 1013. |
| 14 | 28 | WLAFPLCSL | 6.000 | 1014. |
| 15 | 40 | AVLGNLTII | 6.000 | 1015. |
| 16 | 151 | VVRGAALMA | 5.000 | 1016. |
| 17 | 253 | YVPFIGLSM | 5.000 | 1017. |
| 18 | 109 | LSGMESTVL | 4.000 | 1018. |
| 19 | 275 | VILANIYLL | 4.000 | 1019. |
| 20 | 216 | ISFSYLLIL | 4.000 | 1020. |
| 21 | 220 | YLLILKTVL | 4.000 | 1021. |
| 22 | 181 | CLHQDVMKL | 4.000 | 1022. |
| 23 | 254 | VPFIGLSMV | 4.000 | 1023. |
| 24 | 222 | LILKTVLGL | 4.000 | 1024. |
| 25 | 93 | TIQFDACLL | 4.000 | 1025. |
| 26 | 76 | STSSMPKML | 4.000 | 1026. |
| 27 | 49 | YIVRTEHSL | 4.000 | 1027. |
| 28 | 153 | RGAALMAPL | 4.000 | 1028. |
| 29 | 92 | TTIQFDACL | 4.000 | 1029. |
| 30 | 14 | FILIGLPGL | 4.000 | 1030. |
| 31 | 101 | LQIFAIHSL | 4.000 | 1031. |
| 32 | 213 | SLLISFSYL | 4.000 | 1032. |
| 33 | 174 | NILSHSYCL | 4.000 | 1033. |
| 34 | 265 | FSKRRDSPL | 4.000 | 1034. |

TABLE XV-continued

HLA PEPTIDE SCORING RESULTS-101P3A11-B7, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 35 | 37 | YLIAVLGNL | 4.000 | 1035. |
| 36 | 284 | VPPVLNPIV | 4.000 | 1036. |
| 37 | 214 | LLISFSYLL | 4.000 | 1037. |
| 38 | 34 | CSLYLIAVL | 4.000 | 1038. |
| 39 | 66 | CMLSGIDIL | 4.000 | 1039. |
| 40 | 206 | ISAIGLDSL | 4.000 | 1040. |
| 41 | 8 | ESSATYFIL | 4.000 | 1041. |
| 42 | 104 | FAIHSLSGM | 3.000 | 1042. |
| 43 | 283 | LVPPVLNPI | 2.000 | 1043. |
| 44 | 289 | NIPIVYGVKT | 2.000 | 1044. |
| 45 | 195 | RVNVVYGLI | 2.000 | 1045. |
| 46 | 197 | NVVYGLIVI | 2.000 | 1046. |
| 47 | 3 | DPNGNESSA | 2.000 | 1047. |
| 48 | 198 | VVYGLIVII | 2.000 | 1048. |
| 49 | 274 | PVILANIYL | 2.000 | 1049. |
| 50 | 118 | LAMAFDRYV | 1.800 | 1050. |
| 51 | 155 | AALMAPLPV | 1.800 | 1051. |
| 52 | 39 | IAVLGNLTI | 1.200 | 1052. |
| 53 | 21 | GLEEAQFWL | 1.200 | 1053. |
| 54 | 98 | ACLLQIFAI | 1.200 | 1054. |
| 55 | 120 | MAFDRYVAI | 1.200 | 1055. |
| 56 | 208 | AIGLDSLLI | 1.200 | 1056. |
| 57 | 78 | SSMPKMLAI | 1.200 | 1057. |
| 58 | 65 | LCMLSGIDI | 1.200 | 1058. |
| 59 | 30 | AFPLCSLYL | 1.200 | 1059. |
| 60 | 304 | ILRLFHVAT | 1.000 | 1060. |
| 61 | 72 | DILISTSSM | 1.000 | 1061. |
| 62 | 75 | ISTSSMPKM | 1.000 | 1062. |
| 63 | 230 | LTREAQAKA | 1.000 | 1063. |
| 64 | 235 | QAKAFGTCV | 0.600 | 1064. |
| 65 | 251 | IFYVPFIGL | 0.600 | 1065. |
| 66 | 167 | QLPFCRSNI | 0.600 | 1066. |
| 67 | 296 | KTKEIRQRI | 0.600 | 1067. |
| 68 | 135 | ATVLTLPRV | 0.600 | 1068. |
| 69 | 159 | APLPVFIKQ | 0.600 | 1069. |
| 70 | 147 | GVAAVVRGA | 0.500 | 1070. |
| 71 | 50 | IVRTEHSLH | 0.500 | 1071. |
| 72 | 136 | TVLTLPRVT | 0.500 | 1072. |
| 73 | 226 | TVLGLTREA | 0.500 | 1073. |
| 74 | 142 | RVTKIGVAA | 0.500 | 1074. |
| 75 | 119 | AMAFDRYVA | 0.450 | 1075. |
| 76 | 127 | AICHPLRHA | 0.450 | 1076. |
| 77 | 148 | VAAVVRGAA | 0.450 | 1077. |
| 78 | 273 | LPVILANIY | 0.400 | 1078. |
| 79 | 271 | SPLPVILAN | 0.400 | 1079. |
| 80 | 215 | LISFSYLLI | 0.400 | 1080. |
| 81 | 269 | RDSPLPVIL | 0.400 | 1081. |
| 82 | 80 | MPKMLAIFW | 0.400 | 1082. |
| 83 | 124 | RYVAICHPL | 0.400 | 1083. |
| 84 | 9 | SSATYFILI | 0.400 | 1084. |
| 85 | 42 | LGNLTIIYI | 0.400 | 1085. |
| 86 | 60 | PMYIFLCML | 0.400 | 1086. |
| 87 | 280 | IYLLVPPVL | 0.400 | 1087. |
| 88 | 67 | MLSGIDILI | 0.400 | 1088. |
| 89 | 132 | LRHATVLTL | 0.400 | 1089. |
| 90 | 55 | HSLHEPMYI | 0.400 | 1090. |
| 91 | 157 | LMAPLPVFI | 0.400 | 1091. |
| 92 | 138 | LTLPRVTKI | 0.400 | 1092. |
| 93 | 160 | PLPVFIKQL | 0.400 | 1093. |
| 94 | 19 | LPGLEEAQF | 0.400 | 1094. |
| 95 | 194 | IRVNVVYGL | 0.400 | 1095. |
| 96 | 186 | VMKLACDDI | 0.400 | 1096. |
| 97 | 201 | GLIVIISAI | 0.400 | 1097. |
| 98 | 243 | VSHVCAVFI | 0.400 | 1098. |
| 99 | 84 | AIFWFNSTT | 0.300 | 1099. |
| 100 | 248 | AVFIFYVPF | 0.300 | 1100. |

TABLE XVI

HLA PEPTIDE SCORING RESULTS-101P3A11-B7, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 59 | EPMYIFLCML | 240.000 | 1101. |
| 2 | 159 | APLPVFIKQL | 240.000 | 1102. |
| 3 | 273 | LPVILANIYL | 80.000 | 1103. |
| 4 | 193 | DIRVNVVYGL | 40.000 | 1104. |
| 5 | 140 | LPRVTKIGVA | 20.000 | 1105. |
| 6 | 65 | LCMLSGIDIL | 12.000 | 1106. |
| 7 | 10 | SATYFILIGL | 12.000 | 1107. |
| 8 | 24 | EAQFWLAFPL | 12.000 | 1108. |
| 9 | 29 | LAFPLCSLYL | 12.000 | 1109. |
| 10 | 148 | VAAVVRGAAL | 12.000 | 1110. |
| 11 | 149 | AAVVRGAALM | 9.000 | 1111. |
| 12 | 271 | SPLPVILANI | 8.000 | 1112. |
| 13 | 185 | DVMKLACDDI | 6.000 | 1113. |
| 14 | 250 | FIFYVPFIGL | 6.000 | 1114. |
| 15 | 248 | AVFIFYVPFI | 6.000 | 1115. |
| 16 | 108 | SLSGMESTVL | 4.000 | 1116. |
| 17 | 91 | STTIQFDACL | 4.000 | 1117. |
| 18 | 92 | TTIQFDACLL | 4.000 | 1118. |
| 19 | 206 | ISAIGLDSLL | 4.000 | 1119. |
| 20 | 202 | LIVIISAIGL | 4.000 | 1120. |
| 21 | 296 | KTKEIRQRIL | 4.000 | 1121. |
| 22 | 212 | DSLLISFSYL | 4.000 | 1122. |
| 23 | 205 | IISAIGLDSL | 4.000 | 1123. |
| 24 | 131 | PLRHATVLTL | 4.000 | 1124. |
| 25 | 100 | LLQIFAIHSL | 4.000 | 1125. |
| 26 | 109 | LSGMESTVLL | 4.000 | 1126. |
| 27 | 33 | LCSLYLIAVL | 4.000 | 1127. |
| 28 | 221 | LLILKTVLGL | 4.000 | 1128. |
| 29 | 56 | SLHEPMYIFL | 4.000 | 1129. |
| 30 | 215 | LISFSYLLIL | 4.000 | 1130. |
| 31 | 173 | SNILSHSYCL | 4.000 | 1131. |
| 32 | 167 | QLPFCRSNIL | 4.000 | 1132. |
| 33 | 279 | NIYLLVPPVL | 4.000 | 1133. |
| 34 | 75 | ISTSSMPKML | 4.000 | 1134. |
| 35 | 213 | SLLISFSYLL | 4.000 | 1135. |
| 36 | 180 | YCLHQDVMKL | 4.000 | 1136. |
| 37 | 156 | ALMAPLPVFI | 3.600 | 1137. |
| 38 | 274 | PVILANIYLL | 2.000 | 1138. |
| 39 | 301 | RQRILRLFHV | 2.000 | 1139. |
| 40 | 197 | NVVYGLIVII | 2.000 | 1140. |
| 41 | 130 | HPLRHATVLT | 2.000 | 1141. |
| 42 | 31 | FPLCSLYLIA | 2.000 | 1142. |
| 43 | 242 | CVSHVCAVFI | 2.000 | 1143. |
| 44 | 291 | IVYGVKTKEI | 2.000 | 1144. |
| 45 | 3 | DPNGNESSAT | 2.000 | 1145. |
| 46 | 150 | AVVRGAALMA | 1.500 | 1146. |
| 47 | 118 | LAMAFDRYVA | 1.350 | 1147. |
| 48 | 39 | IAVLGNLTII | 1.200 | 1148. |
| 49 | 97 | DACLLQIFAI | 1.200 | 1149. |
| 50 | 85 | AIFWFNSTTI | 1.200 | 1150. |
| 51 | 119 | AMAFDRYVAI | 1.200 | 1151. |
| 52 | 207 | SAIGLDSLLI | 1.200 | 1152. |
| 53 | 195 | RVNVVYGLIV | 1.000 | 1153. |
| 54 | 178 | HSYCLHQDVM | 1.000 | 1154. |
| 55 | 253 | YVPFIGLSMV | 1.000 | 1155. |
| 56 | 142 | RVTKIGVAAV | 1.000 | 1156. |
| 57 | 283 | LVPPVLNPIV | 1.000 | 1157. |
| 58 | 245 | HVCAVFIFYV | 1.000 | 1158. |
| 59 | 74 | LISTSSMPKM | 1.000 | 1159. |
| 60 | 189 | LACDDIRVNV | 0.900 | 1160. |
| 61 | 147 | GVAAVVRGAA | 0.750 | 1161. |
| 62 | 27 | FWLAFPLCSL | 0.600 | 1162. |
| 63 | 154 | GAALMAPLPV | 0.600 | 1163. |
| 64 | 278 | ANIYLLVPPV | 0.600 | 1164. |
| 65 | 166 | KQLPFCRSNI | 0.600 | 1165. |
| 66 | 134 | HATVLTLPRV | 0.600 | 1166. |
| 67 | 267 | KRRDSPLPVI | 0.600 | 1167. |
| 68 | 237 | KAFGTCVSHV | 0.600 | 1168. |
| 69 | 234 | AQAKAFGTCV | 0.600 | 1169. |
| 70 | 50 | IVRTEHSLHE | 0.500 | 1170. |
| 71 | 151 | VVRGAALMAP | 0.500 | 1171. |
| 72 | 127 | AICHPLRHAT | 0.450 | 1172. |
| 73 | 126 | VAICHPLRHA | 0.450 | 1173. |

TABLE XVI-continued

HLA PEPTIDE SCORING RESULTS-101P3A11-B7, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 74 | 36 | LYLIAVLGNL | 0.400 | 1174. |
| 75 | 7 | NESSATYFIL | 0.400 | 1175. |
| 76 | 129 | CHPLRHATVL | 0.400 | 1176. |
| 77 | 214 | LLISFSYLLI | 0.400 | 1177. |
| 78 | 80 | MPKMLAIFWF | 0.400 | 1178. |
| 79 | 66 | CMLSGIDILI | 0.400 | 1179. |
| 80 | 77 | TSSMPKMLAI | 0.400 | 1180. |
| 81 | 168 | LPFCRSNILS | 0.400 | 1181. |
| 82 | 137 | VLTLPRVTKI | 0.400 | 1182. |
| 83 | 19 | LPGLEEAQFW | 0.400 | 1183. |
| 84 | 8 | ESSATYFILI | 0.400 | 1184. |
| 85 | 123 | DRYVAICHPL | 0.400 | 1185. |
| 86 | 298 | KEIRQRILRL | 0.400 | 1186. |
| 87 | 20 | PGLEEAQFWL | 0.400 | 1187. |
| 88 | 94 | IQFDACLLQI | 0.400 | 1188. |
| 89 | 284 | VPPVLNPIVY | 0.400 | 1189. |
| 90 | 196 | VNVVYGLIVI | 0.400 | 1190. |
| 91 | 41 | VLGNLTIIYI | 0.400 | 1191. |
| 92 | 264 | RFSKRRDSPL | 0.400 | 1192. |
| 93 | 38 | LIAVLGNLTI | 0.400 | 1193. |
| 94 | 282 | LLVPPVLNPI | 0.400 | 1194. |
| 95 | 48 | IYIVRTEHSL | 0.400 | 1195. |
| 96 | 13 | YFILIGLPGL | 0.400 | 1196. |
| 97 | 62 | YIFLCMLSGI | 0.400 | 1197. |
| 98 | 64 | FLCMLSGIDI | 0.400 | 1198. |
| 99 | 161 | LPVFIKQLPF | 0.400 | 1199. |
| 100 | 152 | VRGAALMAPL | 0.400 | 1200. |

TABLE XVII

HLA PEPTIDE SCORING RESULTS-101P3A11-B-3501, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 273 | LPVILANIY | 40.000 | 1201. |
| 2 | 59 | EPMYIFLCM | 40.000 | 1202. |
| 3 | 19 | LPGLEEAQF | 30.000 | 1203. |
| 4 | 80 | MPKMLAIFW | 30.000 | 1204. |
| 5 | 130 | HPLRHATVL | 20.000 | 1205. |
| 6 | 172 | RSNILSHSY | 20.000 | 1206. |
| 7 | 168 | LPFCRSNIL | 20.000 | 1207. |
| 8 | 265 | FSKRRDSPL | 15.000 | 1208. |
| 9 | 140 | LPRVTKIGV | 12.000 | 1209. |
| 10 | 212 | DSLLISFSY | 10.000 | 1210. |
| 11 | 75 | ISTSSMPKM | 10.000 | 1211. |
| 12 | 31 | FPLCSLYLI | 8.000 | 1212. |
| 13 | 109 | LSGMESTVL | 7.500 | 1213. |
| 14 | 29 | LAFPLCSLY | 6.000 | 1214. |
| 15 | 104 | FAIHSLSGM | 6.000 | 1215. |
| 16 | 34 | CSLYLIAVL | 5.000 | 1216. |
| 17 | 8 | ESSATYFIL | 5.000 | 1217. |
| 18 | 206 | ISAIGLDSL | 5.000 | 1218. |
| 19 | 216 | ISFSYLLIL | 5.000 | 1219. |
| 20 | 296 | KTKEIRQRI | 4.800 | 1220. |
| 21 | 284 | VPPVLNPIV | 4.000 | 1221. |
| 22 | 5 | NGNESSATY | 4.000 | 1222. |
| 23 | 254 | VPFIGLSMV | 4.000 | 1223. |
| 24 | 285 | PPVLNPIVY | 4.000 | 1224. |
| 25 | 299 | EIRQRILRL | 3.000 | 1225. |
| 26 | 55 | HSLHEPMYI | 3.000 | 1226. |
| 27 | 149 | AAVVRGAAL | 3.000 | 1227. |
| 28 | 207 | SAIGLDSLL | 3.000 | 1228. |
| 29 | 120 | MAFDRYVAI | 2.400 | 1229. |
| 30 | 110 | SGMESTVLL | 2.000 | 1230. |
| 31 | 150 | AVVRGAALM | 2.000 | 1231. |
| 32 | 56 | SLHEPMYIF | 2.000 | 1232. |
| 33 | 78 | SSMPKMLAI | 2.000 | 1233. |
| 34 | 117 | LLAMAFDRY | 2.000 | 1234. |

TABLE XVII-continued

HLA PEPTIDE SCORING RESULTS-101P3A11-B-3501, 9-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 35 | 245 | HVCAVFIFY | 2.000 | 1235. |
| 36 | 243 | VSHVCAVFI | 2.000 | 1236. |
| 37 | 41 | VLGNLTIIY | 2.000 | 1237. |
| 38 | 271 | SPLPVILAN | 2.000 | 1238. |
| 39 | 3 | DPNGNESSA | 2.000 | 1239. |
| 40 | 72 | DILISTSSM | 2.000 | 1240. |
| 41 | 153 | RGAALMAPL | 2.000 | 1241. |
| 42 | 253 | YVPFIGLSM | 2.000 | 1242. |
| 43 | 9 | SSATYFILI | 2.000 | 1243. |
| 44 | 289 | NIPIVYGVKT | 2.000 | 1244. |
| 45 | 235 | QAKAFGTCV | 1.800 | 1245. |
| 46 | 181 | CLHQDVMKL | 1.500 | 1246. |
| 47 | 93 | TIQFDACLL | 1.500 | 1247. |
| 48 | 39 | IAVLGNLTI | 1.200 | 1248. |
| 49 | 186 | VMKLACDDI | 1.200 | 1249. |
| 50 | 275 | VILANIYLL | 1.000 | 1250. |
| 51 | 66 | CMLSGIDIL | 1.000 | 1251. |
| 52 | 49 | YIVRTEHSL | 1.000 | 1252. |
| 53 | 242 | CVSHVCAVF | 1.000 | 1253. |
| 54 | 203 | IVIISAIGL | 1.000 | 1254. |
| 55 | 14 | FILIGLPGL | 1.000 | 1255. |
| 56 | 222 | LILKTVLGL | 1.000 | 1256. |
| 57 | 25 | AQFWLAFPL | 1.000 | 1257. |
| 58 | 214 | LLISFSYLL | 1.000 | 1258. |
| 59 | 114 | STVLLAMAF | 1.000 | 1259. |
| 60 | 101 | LQIFAIHSL | 1.000 | 1260. |
| 61 | 92 | TTIQFDACL | 1.000 | 1261. |
| 62 | 257 | IGLSMVHRF | 1.000 | 1262. |
| 63 | 28 | WLAFPLCSL | 1.000 | 1263. |
| 64 | 79 | SMPKMLAIF | 1.000 | 1264. |
| 65 | 178 | HSYCLHQDV | 1.000 | 1265. |
| 66 | 37 | YLIAVLGNL | 1.000 | 1266. |
| 67 | 174 | NILSHSYCL | 1.000 | 1267. |
| 68 | 156 | ALMAPLPVF | 1.000 | 1268. |
| 69 | 213 | SLLISFSYL | 1.000 | 1269. |
| 70 | 220 | YLLILKTVL | 1.000 | 1270. |
| 71 | 248 | AVFIFYVPF | 1.000 | 1271. |
| 72 | 76 | STSSMPKML | 1.000 | 1272. |
| 73 | 11 | ATYFILIGL | 1.000 | 1273. |
| 74 | 189 | LACDDIRVN | 0.900 | 1274. |
| 75 | 195 | RVNVVYGLI | 0.800 | 1275. |
| 76 | 68 | LSGIDILIS | 0.750 | 1276. |
| 77 | 118 | LAMAFDRYV | 0.600 | 1277. |
| 78 | 143 | VTKIGVAAV | 0.600 | 1278. |
| 79 | 21 | GLEEAQFWL | 0.600 | 1279. |
| 80 | 188 | KLACDDIRV | 0.600 | 1280. |
| 81 | 208 | AIGLDSLLI | 0.600 | 1281. |
| 82 | 155 | AALMAPLPV | 0.600 | 1282. |
| 83 | 230 | LTREAQAKA | 0.600 | 1283. |
| 84 | 113 | ESTVLLAMA | 0.500 | 1284. |
| 85 | 90 | NSTTIQFDA | 0.500 | 1285. |
| 86 | 218 | FSYLLILKT | 0.500 | 1286. |
| 87 | 77 | TSSMPKMLA | 0.500 | 1287. |
| 88 | 107 | HSLSGMEST | 0.500 | 1288. |
| 89 | 270 | DSPLPVILA | 0.500 | 1289. |
| 90 | 167 | QLPFCRSNI | 0.400 | 1290. |
| 91 | 198 | VVYGLIVII | 0.400 | 1291. |
| 92 | 201 | GLIVIISAI | 0.400 | 1292. |
| 93 | 197 | NVVYGLIVI | 0.400 | 1293. |
| 94 | 98 | ACLLQIFAI | 0.400 | 1294. |
| 95 | 67 | MLSGIDILI | 0.400 | 1295. |
| 96 | 138 | LTLPRVTKI | 0.400 | 1296. |
| 97 | 157 | LMAPLPVFI | 0.400 | 1297. |
| 98 | 283 | LVPPVLNPI | 0.400 | 1298. |
| 99 | 40 | AVLGNLTII | 0.400 | 1299. |
| 100 | 215 | LISFSYLLI | 0.400 | 1300. |

TABLE XVIII

HLA PEPTIDE SCORING RESULTS-101P3A11-B-3501, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 1 | 80 | MPKMLAIFWF | 60.000 | 1301. |
| 2 | 284 | VPPVLNPIVY | 40.000 | 1302. |
| 3 | 273 | LPVILANIYL | 20.000 | 1303. |
| 4 | 159 | APLPVFIKQL | 20.000 | 1304. |
| 5 | 59 | EPMYIFLCML | 20.000 | 1305. |
| 6 | 161 | LPVFIKQLPF | 20.000 | 1306. |
| 7 | 19 | LPGLEEAQFW | 15.000 | 1307. |
| 8 | 296 | KTKEIRQRIL | 12.000 | 1308. |
| 9 | 178 | HSYCLHQDVM | 10.000 | 1309. |
| 10 | 271 | SPLPVILANI | 8.000 | 1310. |
| 11 | 140 | LPRVTKIGVA | 6.000 | 1311. |
| 12 | 230 | LTREAQAKAF | 6.000 | 1312. |
| 13 | 149 | AAVVRGAALM | 6.000 | 1313. |
| 14 | 206 | ISAIGLDSLL | 5.000 | 1314. |
| 15 | 75 | ISTSSMPKML | 5.000 | 1315. |
| 16 | 243 | VSHVCAVFIF | 5.000 | 1316. |
| 17 | 212 | DSLLISFSYL | 5.000 | 1317. |
| 18 | 113 | ESTVLLAMAF | 5.000 | 1318. |
| 19 | 78 | SSMPKMLAIF | 5.000 | 1319. |
| 20 | 55 | HSLHEPMYIF | 5.000 | 1220. |
| 21 | 109 | LSGMESTVLL | 5.000 | 1321. |
| 22 | 10 | SATYFILIGL | 3.000 | 1322. |
| 23 | 193 | DIRVNVVYGL | 3.000 | 1323. |
| 24 | 155 | AALMAPLPVF | 3.000 | 1324. |
| 25 | 299 | EIRQRILRLF | 3.000 | 1325. |
| 26 | 3 | DPNGNESSAT | 3.000 | 1326. |
| 27 | 148 | VAAVVRGAAL | 3.000 | 1327. |
| 28 | 29 | LAFPLCSLYL | 3.000 | 1328. |
| 29 | 24 | EAQFWLAFPL | 3.000 | 1329. |
| 30 | 247 | CAVFIFYVPF | 3.000 | 1330. |
| 31 | 56 | SLHEPMYIFL | 2.000 | 1331. |
| 32 | 74 | LISTSSMPKM | 2.000 | 1332. |
| 33 | 130 | HPLRHATVLT | 2.000 | 1333. |
| 34 | 77 | TSSMPKMLAI | 2.000 | 1334. |
| 35 | 5 | NGNESSATYF | 2.000 | 1335. |
| 36 | 116 | VLLAMAFDRY | 2.000 | 1336. |
| 37 | 28 | WLAFPLCSLY | 2.000 | 1337. |
| 38 | 31 | FPLCSLYLIA | 2.000 | 1338. |
| 39 | 168 | LPFCRSNILS | 2.000 | 1339. |
| 40 | 8 | ESSATYFILI | 2.000 | 1340. |
| 41 | 40 | AVLGNLTIIY | 2.000 | 1341. |
| 42 | 209 | IGLDSLLISF | 2.000 | 1342. |
| 43 | 207 | SAIGLDSLLI | 1.800 | 1343. |
| 44 | 18 | GLPGLEEAQF | 1.500 | 1344. |
| 45 | 108 | SLSGMESTVL | 1.500 | 1345. |
| 46 | 180 | YCLHQDVMKL | 1.500 | 1346. |
| 47 | 92 | TTIQFDACLL | 1.500 | 1347. |
| 48 | 237 | KAFGTCVSHV | 1.200 | 1348. |
| 49 | 97 | DACLLQIFAI | 1.200 | 1349. |
| 50 | 39 | IAVLGNLTII | 1.200 | 1350. |
| 51 | 301 | RQRILRLFHV | 1.200 | 1351. |
| 52 | 52 | RTEHSLHEPM | 1.200 | 1352. |
| 53 | 189 | LACDDIRVNV | 1.200 | 1353. |
| 54 | 218 | FSYLLILKTV | 1.000 | 1354. |
| 55 | 241 | TCVSHVCAVF | 1.000 | 1355. |
| 56 | 215 | LISFSYLLIL | 1.000 | 1356. |
| 57 | 33 | LCSLYLIAVL | 1.000 | 1357. |
| 58 | 202 | LIVIISAIGL | 1.000 | 1358. |
| 59 | 221 | LLILKTVLGL | 1.000 | 1359. |
| 60 | 172 | RSNILSHSYC | 1.000 | 1360. |
| 61 | 100 | LLQIFAIHSL | 1.000 | 1361. |
| 62 | 173 | SNILSHSYCL | 1.000 | 1362. |
| 63 | 279 | NIYLLVPPVL | 1.000 | 1363. |
| 64 | 107 | HSLSGMESTV | 1.000 | 1364. |
| 65 | 65 | LCMLSGIDIL | 1.000 | 1365. |
| 66 | 205 | IISAIGLDSL | 1.000 | 1366. |
| 67 | 91 | STTIQFDACL | 1.000 | 1367. |
| 68 | 250 | FIFYVPFIGL | 1.000 | 1368. |
| 69 | 213 | SLLISFSYLL | 1.000 | 1369. |
| 70 | 256 | FIGLSMVHRF | 1.000 | 1370. |
| 71 | 167 | QLPFCRSNIL | 1.000 | 1371. |
| 72 | 235 | QAKAFGTCVS | 0.900 | 1372. |
| 73 | 94 | IQFDACLLQI | 0.800 | 1373. |

TABLE XVIII-continued

HLA PEPTIDE SCORING RESULTS-101P3A11-B-3501, 10-MERS

| RANK | START POSITION | SUBSEQUENCE RESIDUE LISTING | SCORE (ESTIMATE OF HALF TIME OF DISASSOCIATION OF A MOLECULE CONTAINING THIS SUBSEQUENCE) | SEQ.ID# |
|---|---|---|---|---|
| 74 | 166 | KQLPFCRSNI | 0.800 | 1374. |
| 75 | 134 | HATVLTLPRV | 0.600 | 1375. |
| 76 | 111 | GMESTVLLAM | 0.600 | 1376. |
| 77 | 154 | GAALMAPLPV | 0.600 | 1377. |
| 78 | 143 | VTKIGVAAVV | 0.600 | 1378. |
| 79 | 120 | MAFDRYVAIC | 0.600 | 1379. |
| 80 | 68 | LSGIDILIST | 0.500 | 1380. |
| 81 | 90 | NSTTIQFDAC | 0.500 | 1381. |
| 82 | 79 | SMPKMLAIFW | 0.500 | 1382. |
| 83 | 270 | DSPLPVILAN | 0.500 | 1383. |
| 84 | 267 | KRRDSPLPVI | 0.480 | 1384. |
| 85 | 118 | LAMAFDRYVA | 0.450 | 1385. |
| 86 | 291 | IVYGVKTKEI | 0.400 | 1386. |
| 87 | 282 | LLVPPVLNPI | 0.400 | 1387. |
| 88 | 242 | CVSHVCAVFI | 0.400 | 1388. |
| 89 | 64 | FLCMLSGIDI | 0.400 | 1389. |
| 90 | 85 | AIFWFNSTTI | 0.400 | 1390. |
| 91 | 142 | RVTKIGVAAV | 0.400 | 1391. |
| 92 | 137 | VLTLPRVTKI | 0.400 | 1392. |
| 93 | 38 | LIAVLGNLTI | 0.400 | 1393. |
| 94 | 62 | YIFLCMLSGI | 0.400 | 1394. |
| 95 | 214 | LLISFSYLLI | 0.400 | 1395. |
| 96 | 156 | ALMAPLPVFI | 0.400 | 1396. |
| 97 | 41 | VLGNLTIIYI | 0.400 | 1397. |
| 98 | 196 | VNVVYGLIVI | 0.400 | 1398. |
| 99 | 248 | AVFIFYVPFI | 0.400 | 1399. |
| 100 | 200 | YGLIVIISAI | 0.400 | 1400. |

TABLE XIX

Motifs and Post-translational Modifications of 101P3A11

N-glycosylation site

Number of matches: 3

| | | | |
|---|---|---|---|
| 1 | 7–10 | NESS | (SEQ ID NO: 2881) |
| 2 | 44–47 | NLTI | (SEQ ID NO: 2882) |
| 3 | 90–93 | NSTT | (SEQ ID NO: 2883) | cAMP- and cGMP-dependent protein kinase phosphorylation site

| | | | |
|---|---|---|---|
| | 268–271 | RRDS | (SEQ ID NO: 2884) |

Protein kinase C phosphorylation site

| | | | |
|---|---|---|---|
| | 266–268 | SKR | (SEQ ID NO: 2885) |

Casein kinase II phosphorylation site

Number of matches: 3

| | | | |
|---|---|---|---|
| 1 | 56–59 | SLHE | (SEQ ID NO: 2886) |
| 2 | 69–72 | SGID | (SEQ ID NO: 2887) |
| 3 | 110–113 | SGME | (SEQ ID NO: 2888) |

N-myristoylation site

Number of matches: 4

| | | | |
|---|---|---|---|
| 1 | 6–11 | GNESSA | (SEQ ID NO: 2889) |
| 2 | 21–26 | GLEEAQ | (SEQ ID NO: 2890) |
| 3 | 111–116 | GMESTV | (SEQ ID NO: 2891) |
| 4 | 240–245 | GTCVSH | |

G-protein coupled receptors family 1 signature

| | | |
|---|---|---|
| 112–128 | MESTVLLAMAFDRYVAI | (SEQ ID NO: 2892) |

TABLE XX

Frequently Occurring Motifs

| Name | avrg. % identity | Description | Potential Function |
|---|---|---|---|
| zf-C2H2 | 34% | Zinc finger, C2H2 type | Nucleic acid-binding protein functions as tanscription factor, nuclear location probable |
| cytochrome b_N | 68% | Cytochrome b(N-terminal)/b6/petB | membrane bound oxidase, generate superoxide |

TABLE XX-continued

Frequently Occurring Motifs

| Name | avrg. % identity | Description | Potential Function |
|---|---|---|---|
| ig | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| pkinase | 23% | Protein kinase domain | conserved catalytic core common to both serine/threonine and tyrosine protein kinases containing an ATP binding site and a catalytic site |
| PH | 16% | PH domain | pleckstrin homology involved in intracellular signaling or as constituents of the cytoskeleton |
| EGF | 34% | EGF-like domain | 30–40 amino-acid long found in the extracellular domain of membrane-bound proteins or in secreted proteins |
| rvt | 49% | Reverse transcriptase (RNA-dependent DNA polymerase) | |
| ank | 25% | Ank repeat | Cytoplasmic protein, associates integral membrane proteins to the cytoskeleton |
| oxidored_q1 | 32% | NADH-Ubiquinone/plastoquinone (complex I), various chains | membrane associated. Involved in proton translocation across the membrane |
| efhand | 24% | EF hand | calcium-binding domain, consists of a 12 residue loop flanked on both sides by a 12 residue alpha-helical domain |
| rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G-X-Y and the polypeptide chains forms a triple helix. |
| fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic transmembrane regions, with the N-terminus located extracellularly while the C-terminus is cytoplasmic. Signal through G proteins |

TABLE XXI

Nucleotide sequence of the splice variant.

```
  1 CACATTCCTT CCATACGGTT GAGCCTCTAC CTGCCTGGTG
    CTGGTCACAG TTCAGCTTCT
 61 TCATGATGGT GGATCCCAAT GGCAATGAAT CCAGTGCTAC
    ATACTTCATC CTTAATAGGCC
121 TCCCTGGTTT AGAAGAGGCT CAGTTCTGGT TGGCCTCCCA
    TTGTGCTCCC TCTANCTATG
181 CTGTGCTAGT AATTGACAAT CATCTACATG TGCGGACGAG
    CACGNCGCNG AGCCCNGTAT
241 NATTCTGCNG CTTCAGCATG ACACCCTNCA GTCTCAGCCA
    AAGNGCATCT CNGTCAATCA
301 NACACNTGAG CTGTCGTACG AGTTGCATCA TCCTANGGCA
    GGATCAATGT GCGGNAGGCN
361 TGACGCAGTG CACGTACCAT GGCAGCAAGA CAGGGCCGGT
    ACAAATGGGG GCGAGNCGGG
421 GTGAAGATGN ACCCTCGGGT CANAGAGTGC CTCTGCGCCA
    AAACCTCCAT CATGNNAACA
481 GNGTATAACG GCGNAGAATC GGNNANGCGC AAGGCTAAGG
    AAANNCCCAA NNCNGGTACT
541 TTAACCCNGC AAANGGCANC NAAACGGGNG GGTNANTGAA
    CAAGGAAGGN NTGNAACTGG
601 GCCAAAACGG GNTGGGCAAN NNAAGGACTC ATGGGNCCAA
    GGGACGGNAA AAGGGGNAAN
661 CGGGGCGAAA TGNNAAAAAC CGGGNCCCGG GGAANAANGA
    AGGGGAANAN GNGTGAAGGA
721 CNGGGTTCAA GGGAAAAGNA AAACCANGGG NNAGAAACCN
    TTCNAANGGC CCGGGNANGA
781 AAGGAANTNN GNNNGGNGAA AAAATCNAAA AAAAGCNGNG
```

TABLE XXI-continued

Nucleotide sequence of the splice variant.

```
                                   GCNNAAAAAN GGGGGGAANN
841 NAAANACCNN GGNCGNNAAA AAACNNAANG NGGGGGGANT
                                   ANACACGGAA ANNNANGGGC
901 GNNNAAGGGA AATAANNCGG GAACNAAAGN GCAAACCGNA
                                   CGGNAGGAAC GAAACCCACC
961 GGAGNCGCNN AACGCCNNNC NNANCCCGAG CNGAGGTNG
```

TABLE XXII

Nucleotide sequence alignment of 101P3A11 with the splice variant.

```
Score = 337 bits (175), Expect = 4e-89
Identities = 215/223 (96%), Gaps = 6/223 (2%)
Strand = Plus/Plus
101P3A11:   68 cacattccttccatacggttgagcctctacctgcctggtgctggtcacagttcagcttct  127
               ||||||||||||||||||||||||||||||||||||||||||||||||||||||||||||
Variant:     1 cacattccttccatacggttgagcctctacctgcctggtgctggtcacagttcagcttct  60

101P3A11:  128 tcatgatggtggatcccaatggcaatgaatccagtgctacatacttcatcctaataggcc  187
               ||||||||||||||||||||||||||||||||||||||||||||||||||||||||||||
Variant:    61 tcatgatggtggatcccaatggcaatgaatccagtgctacatacttcatcctaataggcc  120

101P3A11:  188 tccctggtttagaagaggctcagttctggttggccttcccattgtgctccctctacctta  247
               |||||||||||||||||||||||||||||| ||||||||||||                ||
Variant:   121 tccctggtttagaagaggctcagttctggttggcc-tcccattgtgctccctctanct--  177

101P3A11:  248 ttgctgtgctaggtaacttgacaatcatctacattgtgcggac  290
               ||||||||  ||| |||||||||||||||||||  |||||||||
Variant:   178 atgctgtgcta-gtaa-ttgacaatcatctaca-tgtgcggac  217
```

TABLE XXIII

Longest single amino acid sequence alignment of 101P3A11 and the splice variant.

```
Score = 134 bits (287), Expect (2) = 3e-29
Identities = 51/51 (100%)
Frame = +1/+3
101P3A11:   70 HSFHTVEPLPAWCWSQFSFFMMVDPNGNESSATYFILIGLPGLEEAQFWLA  222
               HSFHTVEPLPAWCWSQFSFFMMVDPNGNESSATYFILIGLPGLEEAQFWLA
Variant:     3 HSFHTVEPLPAWCWSQFSFFMMVDPNGNESSATYFILIGLPGLEEAQFWLA  155
```

TABLE XXIV

Peptide sequences from the translation of the nucleotide sequence of the splice variant.

| Open reading frame | Amino acid sequences |
|---|---|
| Frame 1 | HIPSIRLSLYLPGAGHSSASS*WWIPMAMNP |
| | VLHTSS**ASLV*KRLSSGWPPIVLPLXMLC |
| | **LTIIYMCGRARRXAXYXSAASA*HPXVSA |
| | KXHLXQSXT*AVVRVASSXGRINVRXA*RSA |
| | RTMAARQGRYKWGRXGVKMXPRVXECLCAKT |
| | SIMXTXYNGXESXXRKAKEXPXXGTLTXQXA |
| | XKRXGX*TRKXXNWAKTGWAXXGLMGPRDGK |
| | RGXRGEMXKTGXRGXXKGXXXEGXGSREKXN |
| | XGXETXXXARXXKEXXXXXKSKKSXGXKXGG |
| | XXXPXXXKNXXXGXXTRKXXGXXGK*XGNXX |
| | ANRTXGTKPTGXAXRXXXPEXRX |
| Frame 2 | TFLPYG*ASTCLVLVTVQLLHDGGSQWQ*IQ |
| | CYILHPNRPPWFRRGSVLVGLPLCSLXLCCA |
| | SN*QSSTCADEHXAEPXXILXLQHDTLQSQP |
| | KXISVNXTXELSYELHHPXAGSMCGRXDAVH |
| | VPWQQDRAGTNGGEXG*RXTLGSXSASAPKP |

TABLE XXIV-continued

Peptide sequences from the translation of the nucleotide sequence of the splice variant.

| Open reading frame | Amino acid sequences |
|---|---|
| | PSXXQXITAXNRXXARLRKXPXXVL*PXKXX |
| | XNGXVXEQGRXXTGPKRXGQXKDSWXQGTXK |
| | GXXGAKXXKPGPGEXXRGXXVKDXVQGKXKT |
| | XGXKPFXXPGXERXXXXXKNXKKAXAXKXGE |
| | XKXXGRXKTXXGGXXHGXXXAXKGNXXGTKX |
| | QTXRXERNPPEXXNAXXXPSXG |
| Frame 3 | HSFHTVEPLPAWCWSQFSFFMMVDPNGNESS |
| | ATYFILIGLPGLEEAQFWLASHCAPSXYAVL |
| | VIDNHLHVRTSTXXSPVXFCXFSMTPXSLSQ |
| | XASXSIXHXSCRTSCIILXQDQCAXGXTQCT |
| | YHGSKTGPVQMGAXRGEDXPSGXRVPLRQNL |
| | HHXNXV*RRRIGXAQG*GXXQXXYFNPAXGX |
| | XTGGXXNKEGXXLGQNGXGXXRTHGXKGRXK |
| | GXXGRNXKNRXPGXXEGEXX*RTGFKGKXXP |
| | XXRNXSXGPGXKGXXXGEKIXKKXXXKXGGX |
| | XXTXXXKKXXXGGXXTEXXGRXREIXREXKX |
| | KPXGRNETHRXRXTPXXXRAEV |

Note:
Frame 3 gives the longest subsequence that is identical with 101P3A11 amino acid sequence. In this Table each (*) indicates the product of a single stop codon, and 'X' indicates a single unknown amino acid.

TABLE XXV

Properties of 101P3A11

| | Bioinformatic Program | URL | Outcome |
|---|---|---|---|
| ORF | ORF Finder | http://www.ncbi.nlm.gov/gorf | 133–1086 (includes stop) |
| Protein Length | n/a | n/a | 317 amino acids |
| Transmembrane region | TM Pred | http://www.ch.embnet.org/ | 7 TM at aa: 27–52, 63–88, 104–129, 146–165, 196–224, 239–262, 273–295 |
| | HMMTop | http://www.enzim.hu/hmmtop/ | 7 TM at aa: 27–50, 63–86, 99–121, 146–165, 201–224, 239–262, 275–294 |
| | Sosui | http://www.genome.ad.jp/SOSui/ | 7 TM, at aa: 29–51, 63–85, 100–122, 203–225, 239–261, 273–295 |
| | TMHMM | http://www.cbs.dtu.dk/services/TMHMM | 7 TM, at aa: 29–51, 63–85, 100–122, 143–165, 202–224, 236–258, 273–295 |
| Signal Peptide | Signal P | http://www.cbs.dtu.dk/services/SignalP/ | indicates no signal |
| pI | pI/MW tool | http://www.expasy.ch/tools/ | pI 8.7 |
| Molecular weight | pI/MW tool | http://www.expasy.ch/tools/ | 35.2 kDa |
| Localization | PSORT | http://psort.nibb.ac.jp/ | Plasma membrane 64% |
| | PSORT II | http://psort.nibb.ac.jp/ | Plasma membrane 56.4% |
| Motifs | Pfam | http://www.sanger.ac.uk/Pfam/ | 7 transmembrane receptor (rhodopsin family) |
| | Prints | http://www.biochem.ucl.ac.uk/ | Rhodopsin-like GPCR superfamily |
| | Blocks | http://www.blocks.fhcrc.org/ | Rhodopsin-like GPCR superfamily |
| | Prosite | http://www.genome.ad.jp/ | G-protein coupled receptors family 1 |

TABLE XXVI

HLA Class I Nonamers

| | POS | 1 | 2 | 3 | 4 | 5 | 6 | 7 | 8 | 9 | score |
|---|---|---|---|---|---|---|---|---|---|---|---|
| | | | | HLA-A1 nonamers | | | | | | | |
| 1 | 245 | H | V | C | A | V | F | I | F | Y | 24 |
| 2 | 29 | L | A | F | P | L | C | S | L | Y | 21 |
| 3 | 41 | V | L | G | N | L | T | I | I | Y | 21 |
| 4 | 285 | P | P | V | L | N | P | I | V | Y | 20 |
| 5 | 111 | G | M | E | S | T | V | L | L | A | 19 |
| 6 | 117 | L | L | A | M | A | F | D | R | Y | 19 |
| 7 | 172 | R | S | N | I | L | S | H | S | Y | 19 |
| 8 | 192 | D | D | I | R | V | N | V | V | Y | 19 |
| 9 | 212 | D | S | L | L | I | S | F | S | Y | 19 |
| 10 | 57 | P | H | E | P | M | Y | I | F | L | 18 |
| 11 | 22 | L | E | E | A | Q | F | W | L | A | 17 |
| 12 | 9 | S | S | A | T | Y | F | I | L | I | 16 |
| 13 | 52 | R | T | E | H | S | L | H | E | P | 16 |
| 14 | 54 | E | H | S | L | H | E | P | M | Y | 16 |
| 15 | 78 | S | S | M | P | K | M | L | A | I | 16 |
| 16 | 95 | Q | F | D | A | C | L | L | Q | I | 16 |
| 17 | 159 | A | P | L | P | V | F | I | K | Q | 16 |
| 18 | 183 | H | Q | D | V | M | K | L | A | C | 16 |
| 19 | 1 | M | V | D | P | N | G | N | E | S | 15 |
| 20 | 5 | N | G | N | E | S | S | A | T | Y | 15 |
| 21 | 210 | G | L | D | S | L | L | I | S | F | 15 |
| 22 | 273 | L | P | V | I | L | A | N | I | Y | 15 |
| 23 | 271 | S | P | L | P | V | I | L | A | N | 14 |
| 24 | 91 | S | T | T | I | Q | F | D | A | C | 13 |
| 25 | 121 | A | F | D | R | Y | V | A | I | C | 13 |
| 26 | 138 | L | T | L | P | R | V | T | K | I | 13 |
| 27 | 218 | F | S | Y | L | L | I | L | K | T | 13 |
| 28 | 282 | L | L | V | P | P | V | L | N | P | 13 |
| 29 | 190 | A | C | D | D | I | R | V | N | V | 12 |
| 30 | 191 | C | D | D | I | R | V | N | V | V | 12 |
| 31 | 231 | T | R | E | A | Q | A | K | A | F | 12 |
| 32 | 268 | R | R | D | S | P | L | P | V | I | 12 |
| 33 | 270 | D | S | P | L | P | V | I | L | A | 12 |
| | | | | HLA-A*0201 nonamers | | | | | | | |
| 1 | 287 | V | L | N | P | I | V | Y | G | V | 30 |
| 2 | 14 | F | I | L | I | G | L | P | G | L | 29 |
| 3 | 28 | W | L | A | F | P | L | C | S | L | 28 |
| 4 | 37 | Y | L | I | A | V | L | G | N | L | 28 |
| 5 | 222 | L | I | L | K | T | V | L | G | L | 28 |
| 6 | 66 | C | M | L | S | G | I | D | I | L | 26 |
| 7 | 108 | S | L | S | G | M | E | S | T | V | 26 |
| 8 | 181 | C | L | H | Q | D | V | M | K | L | 26 |
| 9 | 201 | G | L | I | V | I | S | S | A | I | 26 |
| 10 | 214 | L | L | I | S | F | S | Y | L | L | 26 |
| 11 | 275 | V | I | L | A | N | I | Y | L | L | 26 |
| 12 | 157 | L | M | A | P | L | P | V | F | I | 25 |
| 13 | 220 | Y | L | L | I | L | K | T | V | L | 25 |
| 14 | 276 | I | L | A | N | I | Y | L | L | V | 25 |
| 15 | 279 | N | I | Y | L | L | V | P | P | V | 25 |
| 16 | 138 | L | T | L | P | R | V | T | K | I | 24 |
| 17 | 213 | S | L | L | I | S | F | S | Y | L | 24 |
| 18 | 49 | Y | I | V | R | T | E | H | S | L | 23 |
| 19 | 143 | V | T | K | I | G | V | A | A | V | 23 |
| 20 | 188 | K | L | A | C | D | D | I | R | V | 23 |
| 21 | 198 | V | V | Y | G | L | I | V | I | I | 23 |
| 22 | 21 | G | L | E | E | A | Q | F | W | L | 22 |
| 23 | 40 | A | V | L | G | N | L | T | I | I | 22 |
| 24 | 206 | I | S | A | I | G | L | D | S | L | 22 |
| 25 | 11 | A | T | Y | F | I | L | I | G | L | 21 |
| 26 | 60 | P | M | Y | I | F | L | C | M | L | 21 |
| 27 | 135 | A | T | V | L | T | L | P | R | V | 21 |
| 28 | 160 | P | L | P | V | F | I | K | Q | L | 21 |
| 29 | 174 | N | I | L | S | H | S | Y | C | L | 21 |
| 30 | 207 | S | A | I | G | L | D | S | L | L | 21 |
| 31 | 272 | P | L | P | V | I | L | A | N | I | 21 |
| 32 | 283 | L | V | P | P | V | L | N | P | I | 21 |
| 33 | 67 | M | L | S | G | I | D | I | L | L | 20 |
| 34 | 101 | L | Q | I | F | A | I | H | S | L | 20 |
| 35 | 282 | L | L | V | P | P | V | L | N | P | 20 |
| 36 | 299 | E | I | R | Q | R | I | L | R | L | 20 |
| 37 | 304 | I | L | R | L | F | H | V | A | T | 20 |
| 38 | 39 | I | A | V | L | G | N | L | T | I | 19 |
| 39 | 45 | L | T | I | I | Y | I | V | R | T | 19 |
| 40 | 92 | T | T | I | Q | F | D | A | C | L | 19 |
| 41 | 110 | S | G | M | E | S | T | V | L | L | 19 |
| 42 | 127 | A | I | C | H | P | L | R | H | A | 19 |
| 43 | 132 | L | R | H | A | T | V | L | T | L | 19 |
| 44 | 149 | A | A | V | V | R | G | A | A | L | 19 |
| 45 | 155 | A | A | L | M | A | P | L | P | V | 19 |
| 46 | 156 | A | L | M | A | P | L | P | V | F | 19 |
| 47 | 203 | I | V | I | I | S | A | I | G | L | 19 |
| 48 | 208 | A | I | G | L | D | S | L | L | I | 19 |
| 49 | 216 | I | S | F | S | Y | L | L | I | L | 19 |
| 50 | 219 | S | Y | L | L | I | L | K | T | V | 19 |
| 51 | 221 | L | L | I | L | K | T | V | L | G | 19 |
| 52 | 223 | I | L | K | T | V | L | G | L | T | 19 |
| 53 | 17 | I | G | L | P | G | L | E | E | A | 18 |
| 54 | 33 | L | C | S | L | Y | L | I | A | V | 18 |
| 55 | 34 | C | S | L | Y | L | I | A | V | L | 18 |
| 56 | 38 | L | I | A | V | L | G | N | L | T | 18 |
| 57 | 43 | G | N | L | T | I | I | Y | I | V | 18 |
| 58 | 85 | A | I | F | W | F | N | S | T | T | 18 |
| 59 | 118 | L | A | M | A | F | D | R | Y | V | 18 |
| 60 | 194 | I | R | V | N | V | V | Y | G | L | 18 |
| 61 | 210 | G | L | D | S | L | L | I | S | F | 18 |
| 62 | 215 | L | I | S | F | S | Y | L | L | I | 18 |
| 63 | 246 | V | C | A | V | F | I | F | Y | V | 18 |
| 64 | 254 | V | P | F | I | G | L | S | M | V | 18 |
| 65 | 15 | I | L | I | G | L | P | G | L | E | 17 |
| 66 | 63 | I | F | L | C | M | L | S | G | I | 17 |
| 67 | 72 | D | I | L | I | S | T | S | S | M | 17 |
| 68 | 93 | T | I | Q | F | D | A | C | L | L | 17 |
| 69 | 98 | A | C | L | L | Q | I | F | A | I | 17 |
| 70 | 111 | G | M | E | S | T | V | L | L | A | 17 |
| 71 | 120 | M | A | F | D | R | Y | V | A | I | 17 |
| 72 | 167 | Q | L | P | F | C | R | S | N | I | 17 |
| 73 | 197 | N | V | V | Y | G | L | I | V | I | 17 |
| 74 | 226 | T | V | L | G | L | T | R | E | A | 17 |
| 75 | 281 | Y | L | L | V | P | P | V | L | N | 17 |
| 76 | 31 | F | P | L | C | S | L | Y | L | I | 16 |
| 77 | 56 | S | L | H | E | P | M | Y | I | F | 16 |
| 78 | 70 | G | I | D | I | L | I | S | T | S | 16 |
| 79 | 78 | S | S | M | P | K | M | L | A | I | 16 |
| 80 | 79 | S | M | P | K | M | L | A | I | F | 16 |
| 81 | 104 | F | A | I | H | S | L | S | G | M | 16 |
| 82 | 119 | A | M | A | F | D | R | Y | V | A | 16 |
| 83 | 144 | T | K | I | G | V | A | A | V | V | 16 |
| 84 | 147 | G | V | A | A | V | V | R | G | A | 16 |
| 85 | 186 | V | M | K | L | A | C | D | D | I | 16 |
| 86 | 230 | L | T | R | E | A | Q | A | K | A | 16 |
| 87 | 238 | A | F | G | T | C | V | S | H | V | 16 |
| 88 | 249 | V | F | I | F | Y | V | P | F | I | 16 |
| 89 | 302 | Q | R | I | L | R | L | F | H | V | 16 |
| 90 | 303 | R | I | L | R | L | F | H | V | A | 16 |
| 91 | 18 | G | L | P | G | L | E | E | A | Q | 15 |
| 92 | 35 | S | L | Y | L | I | A | V | L | G | 15 |
| 93 | 42 | L | G | N | L | T | I | I | Y | I | 15 |
| 94 | 46 | T | I | I | Y | I | V | R | T | E | 15 |
| 95 | 69 | S | G | I | D | I | L | I | S | T | 15 |
| 96 | 76 | S | T | S | S | M | P | K | M | L | 15 |
| 97 | 131 | P | L | R | H | A | T | V | L | T | 15 |
| 98 | 137 | V | L | T | L | P | R | V | T | K | 15 |
| 99 | 153 | R | G | A | A | L | M | A | P | L | 15 |
| 100 | 190 | A | C | D | D | I | R | V | N | V | 15 |
| 101 | 191 | C | D | D | I | R | V | N | V | V | 15 |
| 102 | 204 | V | I | I | S | A | I | G | L | D | 15 |
| 103 | 241 | T | C | V | S | H | V | C | A | V | 15 |
| 104 | 251 | I | F | Y | V | P | F | I | G | L | 15 |
| 105 | 269 | R | D | S | P | L | P | V | I | L | 15 |
| 106 | 280 | I | Y | L | L | V | P | P | V | L | 15 |
| 107 | 306 | R | L | F | H | V | A | T | H | A | 15 |
| | | | | HLA A*0203 nonamers | | | | | | | |
| 1 | 148 | V | A | A | V | V | R | G | A | A | 14 |
| 2 | 119 | A | M | A | F | D | R | Y | V | A | 13 |
| 3 | 147 | G | V | A | A | V | V | R | G | A | 12 |
| 4 | 97 | D | A | C | L | L | Q | I | F | A | 11 |

TABLE XXVI-continued

HLA Class I Nonamers

| | POS | 1 | 2 | 3 | 4 | 5 | 6 | 7 | 8 | 9 | score |
|---|---|---|---|---|---|---|---|---|---|---|---|
| 5 | 127 | A | I | C | H | P | L | R | H | A | 10 |
| 6 | 3 | D | P | N | G | N | E | S | S | A | 9 |
| 7 | 17 | I | G | L | P | G | L | E | E | A | 9 |
| 8 | 22 | L | E | E | A | Q | F | W | L | A | 9 |
| 9 | 32 | P | L | C | S | L | Y | L | I | A | 9 |
| 10 | 77 | T | S | S | M | P | K | M | L | A | 9 |
| 11 | 90 | N | S | T | T | I | Q | F | D | A | 9 |
| 12 | 111 | G | M | E | S | T | V | L | L | A | 9 |
| 13 | 113 | E | S | T | V | L | L | A | M | A | 9 |
| 14 | 141 | P | R | V | T | K | I | G | V | A | 9 |
| 15 | 142 | R | V | T | K | I | G | V | A | A | 9 |
| 16 | 151 | V | V | R | G | A | A | L | M | A | 9 |
| 17 | 182 | L | H | Q | D | V | M | K | L | A | 9 |
| 18 | 200 | Y | G | L | I | V | I | I | S | A | 9 |
| 19 | 226 | T | V | L | G | L | T | R | E | A | 9 |
| 20 | 228 | L | G | L | T | R | E | A | Q | A | 9 |
| 21 | 230 | L | T | R | E | A | Q | A | K | A | 9 |
| 22 | 240 | G | T | C | V | S | H | V | C | A | 9 |
| 23 | 270 | D | S | P | L | P | V | I | L | A | 9 |
| 24 | 303 | R | I | L | R | L | F | H | V | A | 9 |
| 25 | 306 | R | L | F | H | V | A | T | H | A | 9 |

HLA-A26 nonamers

| | POS | 1 | 2 | 3 | 4 | 5 | 6 | 7 | 8 | 9 | score |
|---|---|---|---|---|---|---|---|---|---|---|---|
| 1 | 299 | E | I | R | Q | R | I | L | R | L | 30 |
| 2 | 72 | D | I | L | I | S | T | S | M | L | 27 |
| 3 | 248 | A | V | F | I | F | Y | V | P | F | 27 |
| 4 | 210 | G | L | D | S | L | L | I | S | F | 26 |
| 5 | 14 | F | I | L | I | G | L | P | G | L | 24 |
| 6 | 56 | S | L | H | E | P | M | Y | I | F | 24 |
| 7 | 117 | L | L | A | M | A | F | D | R | Y | 24 |
| 8 | 222 | L | I | L | K | T | V | L | G | L | 24 |
| 9 | 245 | H | V | C | A | V | F | I | F | Y | 24 |
| 10 | 11 | A | T | Y | F | I | L | I | G | L | 23 |
| 11 | 37 | Y | L | I | A | V | L | G | N | L | 23 |
| 12 | 114 | S | T | V | L | L | A | M | A | F | 23 |
| 13 | 156 | A | L | M | A | P | L | P | V | F | 23 |
| 14 | 162 | P | V | F | I | K | Q | L | P | F | 23 |
| 15 | 181 | C | L | H | Q | D | V | M | K | L | 23 |
| 16 | 28 | W | L | A | F | P | L | C | S | L | 22 |
| 17 | 92 | T | T | I | Q | F | D | A | C | L | 22 |
| 18 | 160 | P | L | P | V | F | I | K | Q | L | 22 |
| 19 | 203 | I | V | I | I | S | A | I | G | L | 22 |
| 20 | 213 | S | L | L | I | S | F | S | Y | L | 22 |
| 21 | 275 | V | I | L | A | N | I | Y | L | L | 22 |
| 22 | 193 | D | I | R | V | N | V | V | Y | L | 21 |
| 23 | 242 | C | V | S | H | V | C | A | V | F | 21 |
| 24 | 76 | S | T | S | S | M | P | K | M | L | 20 |
| 25 | 253 | Y | V | P | F | I | G | L | S | M | 20 |
| 26 | 274 | P | V | I | L | A | N | I | Y | L | 20 |
| 27 | 23 | E | A | Q | F | W | L | A | F | 19 |
| 28 | 41 | V | L | G | N | L | T | I | I | Y | 19 |
| 29 | 49 | Y | I | V | R | T | E | H | S | L | 19 |
| 30 | 150 | A | V | V | R | G | A | A | L | M | 19 |
| 31 | 174 | N | I | L | S | H | S | Y | C | L | 19 |
| 32 | 192 | D | D | I | R | V | N | V | V | Y | 19 |
| 33 | 214 | L | L | I | S | F | S | Y | L | L | 19 |
| 34 | 251 | I | F | Y | V | P | F | I | G | L | 19 |
| 35 | 8 | E | S | S | A | T | Y | F | I | L | 18 |
| 36 | 21 | G | L | E | E | A | Q | F | W | L | 18 |
| 37 | 45 | L | T | I | I | Y | I | V | R | T | 18 |
| 38 | 54 | E | H | S | L | H | E | P | M | Y | 18 |
| 39 | 59 | E | P | M | Y | I | F | L | C | M | 18 |
| 40 | 88 | W | F | N | S | T | T | I | Q | F | 18 |
| 41 | 93 | T | T | I | Q | F | D | A | C | L | 18 |
| 42 | 185 | D | V | M | K | L | A | C | D | D | 18 |
| 43 | 198 | V | V | Y | G | L | I | V | I | I | 18 |
| 44 | 62 | Y | I | F | L | C | M | L | S | G | 17 |
| 45 | 70 | G | I | D | I | L | I | S | T | S | 17 |
| 46 | 79 | S | M | P | K | M | L | A | I | F | 17 |
| 47 | 96 | F | D | A | C | L | L | Q | I | F | 17 |
| 48 | 104 | F | A | I | H | S | L | S | G | M | 17 |
| 49 | 138 | L | T | L | P | R | V | T | K | I | 17 |
| 50 | 143 | V | T | K | I | G | V | A | V | A | 17 |
| 51 | 204 | V | I | I | S | A | I | G | L | D | 17 |
| 52 | 212 | D | S | L | L | I | S | F | S | Y | 17 |

HLA Class I Nonamers

| | POS | 1 | 2 | 3 | 4 | 5 | 6 | 7 | 8 | 9 | score |
|---|---|---|---|---|---|---|---|---|---|---|---|
| 53 | 220 | Y | L | L | I | L | K | T | V | L | 17 |
| 54 | 256 | F | I | G | L | S | M | V | H | R | 17 |
| 55 | 283 | L | V | P | P | V | L | N | P | I | 17 |
| 56 | 29 | L | A | F | P | L | C | S | L | Y | 16 |
| 57 | 40 | A | V | L | G | N | L | T | I | I | 16 |
| 58 | 46 | T | I | I | Y | I | V | R | T | E | 16 |
| 59 | 52 | R | T | E | H | S | L | H | E | P | 16 |
| 60 | 75 | I | S | T | S | S | M | P | K | M | 16 |
| 61 | 91 | S | T | T | I | Q | F | D | A | C | 16 |
| 62 | 135 | A | T | V | L | T | L | P | R | V | 16 |
| 63 | 147 | G | V | A | A | V | V | R | G | A | 16 |
| 64 | 201 | G | L | I | V | I | I | S | A | I | 16 |
| 65 | 257 | I | G | L | S | M | V | H | R | F | 16 |
| 66 | 279 | N | I | Y | L | L | V | P | P | V | 16 |
| 67 | 30 | A | F | P | L | C | S | L | Y | L | 15 |
| 68 | 101 | L | Q | I | F | A | I | H | S | L | 15 |
| 69 | 115 | T | V | L | L | A | M | A | F | D | 15 |
| 70 | 127 | A | I | C | H | P | L | R | H | A | 15 |
| 71 | 153 | R | G | A | A | L | M | A | P | L | 15 |
| 72 | 163 | V | F | I | K | Q | L | P | F | C | 15 |
| 73 | 215 | L | I | S | F | S | Y | L | L | I | 15 |
| 74 | 216 | I | S | F | S | Y | L | L | I | L | 15 |
| 75 | 225 | K | T | V | L | G | L | T | R | E | 15 |
| 76 | 272 | P | L | P | V | I | L | A | N | I | 15 |
| 77 | 282 | L | L | V | P | P | V | L | N | P | 15 |
| 78 | 286 | P | V | L | N | P | I | V | Y | G | 15 |
| 79 | 287 | V | L | N | P | I | V | Y | G | V | 15 |
| 80 | 296 | K | T | K | E | I | R | Q | R | I | 15 |
| 81 | 303 | R | I | L | R | L | F | H | V | A | 15 |

HLA-A3 nonamers

| | POS | 1 | 2 | 3 | 4 | 5 | 6 | 7 | 8 | 9 | score |
|---|---|---|---|---|---|---|---|---|---|---|---|
| 1 | 137 | V | L | T | L | P | R | V | T | K | 30 |
| 2 | 229 | G | L | T | R | E | A | Q | A | K | 27 |
| 3 | 145 | K | I | G | V | A | A | V | V | R | 26 |
| 4 | 150 | A | V | V | R | G | A | A | L | M | 24 |
| 5 | 290 | P | I | V | Y | G | V | K | T | K | 24 |
| 6 | 35 | S | L | Y | L | I | A | V | L | G | 23 |
| 7 | 156 | A | L | M | A | P | L | P | V | F | 23 |
| 8 | 47 | I | I | Y | I | V | R | T | E | H | 22 |
| 9 | 50 | I | V | R | T | E | H | S | L | H | 22 |
| 10 | 142 | R | V | T | K | I | G | V | A | A | 22 |
| 11 | 151 | V | V | R | G | A | A | L | M | A | 22 |
| 12 | 242 | C | V | S | H | V | C | A | V | F | 22 |
| 13 | 248 | A | V | F | I | F | Y | V | P | F | 22 |
| 14 | 116 | V | L | L | A | M | A | F | D | R | 21 |
| 15 | 192 | D | D | I | R | V | N | V | V | Y | 21 |
| 16 | 303 | R | I | L | R | L | F | H | V | A | 21 |
| 17 | 304 | I | L | R | L | F | H | V | A | T | 21 |
| 18 | 108 | S | L | S | G | M | E | S | T | V | 20 |
| 19 | 198 | V | V | Y | G | L | I | V | I | I | 20 |
| 20 | 291 | I | V | Y | G | V | K | T | K | E | 20 |
| 21 | 15 | I | L | I | G | L | P | G | L | E | 19 |
| 22 | 44 | N | L | T | I | I | Y | I | V | R | 19 |
| 23 | 73 | L | I | S | T | S | S | M | P | K | 19 |
| 24 | 74 | L | I | S | T | S | S | M | P | K | 19 |
| 25 | 99 | C | L | L | Q | I | F | A | I | H | 19 |
| 26 | 162 | P | V | F | I | K | Q | L | P | F | 19 |
| 27 | 203 | I | V | I | I | S | A | I | G | L | 19 |
| 28 | 221 | L | L | I | L | K | T | V | L | G | 19 |
| 29 | 245 | H | V | C | A | V | F | I | F | Y | 19 |
| 30 | 306 | R | L | F | H | V | A | T | H | A | 19 |
| 31 | 40 | A | V | L | G | N | L | T | I | I | 18 |
| 32 | 85 | A | I | F | W | F | N | S | T | T | 18 |
| 33 | 205 | I | I | S | A | I | G | L | D | S | 18 |
| 34 | 220 | Y | L | L | I | L | K | T | V | L | 18 |
| 35 | 253 | Y | V | P | F | I | G | L | S | M | 18 |
| 36 | 37 | Y | L | I | A | V | L | G | N | L | 17 |
| 37 | 41 | V | L | G | N | L | T | I | I | Y | 17 |
| 38 | 117 | L | L | A | M | A | F | D | R | Y | 17 |
| 39 | 131 | P | V | R | H | A | T | V | L | T | 17 |
| 40 | 136 | T | V | L | T | L | P | R | V | T | 17 |
| 41 | 180 | Y | C | L | H | Q | D | V | M | K | 17 |
| 42 | 201 | G | L | I | V | I | I | S | A | I | 17 |
| 43 | 213 | S | L | L | I | S | F | S | Y | L | 17 |
| 44 | 256 | F | I | G | L | S | M | V | H | R | 17 |

TABLE XXVI-continued

HLA Class I Nonamers

| POS | 1 | 2 | 3 | 4 | 5 | 6 | 7 | 8 | 9 | score |
|---|---|---|---|---|---|---|---|---|---|---|
| 45 | 261 | M | V | H | R | F | S | K | R | R | 17 |
| 46 | 276 | I | L | A | N | I | Y | L | L | V | 17 |
| 47 | 281 | Y | L | L | V | P | P | V | L | N | 17 |
| 48 | 286 | P | V | L | N | P | I | V | Y | G | 17 |
| 49 | 288 | L | N | P | I | V | Y | G | V | K | 17 |
| 50 | 309 | H | V | A | T | H | A | S | E | P | 17 |
| 51 | 1 | M | V | D | P | N | G | N | E | S | 16 |
| 52 | 56 | S | L | H | E | P | M | Y | I | F | 16 |
| 53 | 70 | G | I | D | I | L | I | S | T | S | 16 |
| 54 | 72 | D | I | L | I | S | T | S | S | M | 16 |
| 55 | 115 | T | V | L | L | A | M | A | F | D | 16 |
| 56 | 125 | Y | V | A | I | C | H | P | L | R | 16 |
| 57 | 144 | T | K | I | G | V | A | A | V | V | 16 |
| 58 | 167 | Q | L | P | F | C | R | S | N | I | 16 |
| 59 | 175 | I | L | S | H | S | Y | C | L | H | 16 |
| 60 | 195 | R | V | N | V | V | Y | G | L | I | 16 |
| 61 | 197 | N | V | V | Y | G | L | I | V | I | 16 |
| 62 | 210 | G | L | D | S | L | L | I | S | F | 16 |
| 63 | 282 | L | L | V | P | P | V | L | N | P | 16 |
| 64 | 299 | E | I | R | Q | R | I | L | R | L | 16 |
| 65 | 301 | R | Q | R | I | L | R | L | F | H | 16 |
| 66 | 16 | L | I | G | L | P | G | L | E | E | 15 |
| 67 | 46 | T | I | I | Y | I | V | R | T | E | 15 |
| 68 | 102 | Q | I | F | A | I | H | S | L | S | 15 |
| 69 | 193 | D | I | R | V | N | V | V | Y | G | 15 |
| 70 | 208 | A | I | G | L | D | S | L | L | I | 15 |
| 71 | 223 | I | L | K | T | V | L | G | L | T | 15 |
| 72 | 237 | K | A | F | G | T | C | V | S | H | 15 |

HLA-B*0702 nonomers

| POS | 1 | 2 | 3 | 4 | 5 | 6 | 7 | 8 | 9 | score |
|---|---|---|---|---|---|---|---|---|---|---|
| 1 | 130 | H | P | L | R | H | A | T | V | L | 22 |
| 2 | 59 | E | P | M | Y | I | F | L | C | M | 21 |
| 3 | 168 | L | P | F | C | R | S | N | I | L | 20 |
| 4 | 289 | N | P | I | V | Y | G | V | K | T | 19 |
| 5 | 3 | D | P | N | G | N | E | S | S | A | 18 |
| 6 | 19 | L | P | G | L | E | E | A | Q | F | 18 |
| 7 | 140 | L | P | R | V | T | K | I | G | V | 18 |
| 8 | 284 | V | P | P | V | L | N | P | I | V | 17 |
| 9 | 31 | F | P | L | C | S | L | Y | L | I | 16 |
| 10 | 254 | V | P | F | I | G | L | S | M | V | 16 |
| 11 | 269 | R | D | S | P | L | P | V | I | L | 16 |
| 12 | 149 | A | A | V | V | R | G | A | A | L | 15 |
| 13 | 153 | R | G | A | A | L | M | A | P | L | 15 |
| 14 | 156 | A | L | M | A | P | L | P | V | F | 15 |
| 15 | 251 | I | F | Y | V | P | F | I | G | L | 15 |
| 16 | 299 | E | I | R | Q | R | I | L | R | L | 15 |
| 17 | 8 | E | S | S | A | T | Y | F | I | L | 14 |
| 18 | 28 | W | L | A | F | P | L | C | S | L | 14 |
| 19 | 30 | A | F | P | L | C | S | L | Y | L | 14 |
| 20 | 110 | S | G | M | E | S | T | V | L | L | 14 |
| 21 | 132 | L | R | H | A | T | V | L | T | L | 14 |
| 22 | 159 | A | P | L | P | V | F | I | K | Q | 14 |
| 23 | 222 | L | I | L | K | T | V | L | G | L | 14 |
| 24 | 271 | S | P | L | P | V | I | L | A | N | 14 |
| 25 | 25 | A | Q | F | W | L | A | F | P | L | 13 |
| 26 | 109 | L | S | G | M | E | S | T | V | L | 13 |
| 27 | 124 | R | Y | V | A | I | C | H | P | L | 13 |
| 28 | 216 | I | S | F | S | Y | L | L | I | L | 13 |
| 29 | 268 | R | R | D | S | P | L | P | V | I | 13 |
| 30 | 280 | I | Y | L | L | V | P | P | V | L | 13 |
| 31 | 11 | A | T | Y | F | I | L | I | G | L | 12 |
| 32 | 34 | C | S | L | Y | L | I | A | V | L | 12 |
| 33 | 57 | L | H | E | P | M | Y | I | F | L | 12 |
| 34 | 76 | S | T | S | S | M | P | K | M | L | 12 |
| 35 | 142 | R | V | T | K | I | G | V | A | A | 12 |
| 36 | 151 | V | V | R | G | A | A | L | M | A | 12 |
| 37 | 190 | A | C | D | D | I | R | V | N | V | 12 |
| 38 | 194 | I | R | V | N | V | V | Y | G | L | 12 |
| 39 | 206 | I | S | A | I | G | L | D | S | L | 12 |
| 40 | 207 | S | A | I | G | L | D | S | L | L | 12 |
| 41 | 220 | Y | L | L | I | L | K | T | V | L | 12 |
| 42 | 267 | K | R | R | D | S | P | L | P | V | 12 |
| 43 | 304 | I | L | R | L | F | H | V | A | T | 12 |
| 44 | 14 | F | I | L | I | G | L | P | G | L | 11 |
| 45 | 23 | E | E | A | Q | F | W | L | A | F | 11 |
| 46 | 37 | Y | L | I | A | V | L | G | N | L | 11 |
| 47 | 40 | A | V | L | G | N | L | T | I | I | 11 |
| 48 | 77 | T | S | S | M | P | K | M | L | A | 11 |
| 49 | 78 | S | S | M | P | K | M | L | A | I | 11 |
| 50 | 80 | M | P | K | M | L | A | I | F | W | 11 |
| 51 | 92 | T | T | I | Q | F | D | A | C | L | 11 |
| 52 | 112 | M | E | S | T | V | L | L | A | M | 11 |
| 53 | 119 | A | M | A | F | D | R | Y | V | A | 11 |
| 54 | 127 | A | I | C | H | P | L | R | H | A | 11 |
| 55 | 131 | P | L | R | H | A | T | V | L | T | 11 |
| 56 | 155 | A | A | L | M | A | P | L | P | V | 11 |
| 57 | 157 | L | M | A | P | L | P | V | F | I | 11 |
| 58 | 181 | C | L | H | Q | D | V | M | K | L | 11 |
| 59 | 203 | I | V | I | I | S | A | I | G | L | 11 |
| 60 | 208 | A | I | G | L | D | S | L | L | I | 11 |
| 61 | 213 | S | L | L | I | S | F | S | Y | L | 11 |
| 62 | 248 | A | V | F | I | F | Y | V | P | F | 11 |
| 63 | 265 | F | S | K | R | R | D | S | P | L | 11 |
| 64 | 275 | V | I | L | A | N | I | Y | L | L | 11 |
| 65 | 285 | P | P | V | L | N | P | I | V | Y | 11 |

HLA-B*08 nonomers

| POS | 1 | 2 | 3 | 4 | 5 | 6 | 7 | 8 | 9 | score |
|---|---|---|---|---|---|---|---|---|---|---|
| 1 | 299 | E | I | R | Q | R | I | L | R | L | 31 |
| 2 | 265 | F | S | K | R | R | D | S | P | L | 29 |
| 3 | 149 | A | A | V | V | R | G | A | A | L | 24 |
| 4 | 168 | L | P | F | C | R | S | N | I | L | 24 |
| 5 | 294 | G | V | K | T | K | E | I | R | Q | 21 |
| 6 | 120 | M | A | F | D | R | Y | V | A | I | 20 |
| 7 | 292 | V | Y | G | V | K | T | K | E | I | 20 |
| 8 | 21 | G | L | E | E | A | Q | F | W | L | 19 |
| 9 | 78 | S | S | M | P | K | M | L | A | I | 19 |
| 10 | 160 | P | L | P | V | F | I | K | Q | L | 19 |
| 11 | 186 | V | M | K | L | A | C | D | D | I | 18 |
| 12 | 213 | S | L | L | I | S | F | S | Y | L | 18 |
| 13 | 221 | L | L | I | L | K | T | V | L | G | 18 |
| 14 | 296 | K | T | K | E | I | R | Q | R | I | 18 |
| 15 | 297 | T | K | E | I | R | Q | R | I | L | 18 |
| 16 | 130 | H | P | L | R | H | A | T | V | L | 17 |
| 17 | 181 | C | L | H | Q | D | V | M | K | L | 17 |
| 18 | 223 | I | L | K | T | V | L | G | L | T | 17 |
| 19 | 28 | W | L | A | F | P | L | C | S | L | 16 |
| 20 | 37 | Y | L | I | A | V | L | G | N | L | 16 |
| 21 | 56 | S | L | H | E | P | M | Y | I | F | 16 |
| 22 | 80 | M | P | K | M | L | A | I | F | W | 16 |
| 23 | 162 | P | V | F | I | K | Q | L | P | F | 16 |
| 24 | 201 | L | I | V | I | I | S | A | I | L | 16 |
| 25 | 207 | S | A | I | G | L | D | S | L | L | 16 |
| 26 | 214 | L | L | I | S | F | S | Y | L | L | 16 |
| 27 | 220 | Y | L | L | I | L | K | T | V | L | 16 |
| 28 | 233 | E | A | Q | A | K | A | F | G | T | 16 |
| 29 | 275 | V | I | L | A | N | I | Y | L | L | 16 |
| 30 | 304 | I | L | R | L | F | H | V | A | T | 16 |
| 31 | 14 | F | I | L | I | G | L | P | G | L | 15 |
| 32 | 110 | S | G | M | E | S | T | V | L | L | 15 |
| 33 | 138 | L | T | L | P | R | V | T | K | I | 15 |
| 34 | 164 | F | I | K | Q | L | P | F | C | R | 15 |
| 35 | 222 | L | I | L | K | T | V | L | G | L | 15 |

HLA-B*1510 nonomers

| POS | 1 | 2 | 3 | 4 | 5 | 6 | 7 | 8 | 9 | score |
|---|---|---|---|---|---|---|---|---|---|---|
| 1 | 57 | L | H | E | P | M | Y | I | F | L | 23 |
| 2 | 244 | S | H | V | C | A | V | F | I | F | 17 |
| 3 | 269 | R | D | S | P | L | P | V | I | L | 16 |
| 4 | 280 | I | Y | L | L | V | P | P | V | L | 16 |
| 5 | 262 | V | H | R | F | S | K | R | R | D | 15 |
| 6 | 299 | E | I | R | Q | R | I | L | R | L | 15 |
| 7 | 106 | I | H | S | L | S | G | M | E | S | 14 |
| 8 | 206 | I | S | A | I | G | L | D | S | L | 14 |
| 9 | 220 | Y | L | L | I | L | K | T | V | L | 14 |
| 10 | 251 | I | F | Y | V | P | F | I | G | L | 14 |
| 11 | 297 | T | K | E | I | R | Q | R | I | L | 14 |
| 12 | 21 | G | L | E | E | A | Q | F | W | L | 13 |
| 13 | 34 | C | S | L | Y | L | I | A | V | L | 13 |
| 14 | 54 | E | H | S | L | H | E | P | M | Y | 13 |
| 15 | 110 | S | G | M | E | S | T | V | L | L | 13 |
| 16 | 194 | I | R | V | N | V | V | Y | G | L | 13 |

TABLE XXVI-continued

HLA Class I Nonamers

| | POS | 1 | 2 | 3 | 4 | 5 | 6 | 7 | 8 | 9 | score |
|---|---|---|---|---|---|---|---|---|---|---|---|
| 17 | 8 | E | S | S | A | T | Y | F | I | L | 12 |
| 18 | 14 | F | I | L | I | G | L | P | G | L | 12 |
| 19 | 28 | W | L | A | F | P | L | C | S | L | 12 |
| 20 | 66 | C | M | L | S | G | I | D | I | L | 12 |
| 21 | 76 | S | T | S | S | M | P | K | M | L | 12 |
| 22 | 92 | T | T | I | Q | F | D | A | C | L | 12 |
| 23 | 109 | L | S | G | M | E | S | T | V | L | 12 |
| 24 | 130 | H | P | L | R | H | A | T | V | L | 12 |
| 25 | 132 | L | R | H | A | T | V | L | T | L | 12 |
| 26 | 149 | A | A | V | V | R | G | A | A | L | 12 |
| 27 | 153 | R | G | A | A | L | M | A | P | L | 12 |
| 28 | 160 | P | L | P | V | F | I | K | Q | L | 12 |
| 29 | 181 | C | L | H | Q | D | V | M | K | L | 12 |
| 30 | 182 | L | H | Q | D | V | M | K | L | A | 12 |
| 31 | 203 | I | V | I | I | S | A | I | G | L | 12 |
| 32 | 216 | I | S | F | S | Y | L | L | I | L | 12 |
| 33 | 222 | L | I | L | K | T | V | L | G | L | 12 |
| 34 | 275 | V | I | L | A | N | I | Y | L | L | 12 |
| 35 | 37 | Y | L | I | A | V | L | G | N | L | 11 |
| 36 | 49 | Y | I | V | R | T | E | H | S | L | 11 |
| 37 | 93 | T | I | Q | F | D | A | C | L | L | 11 |
| 38 | 101 | L | Q | I | F | A | I | H | S | L | 11 |
| 39 | 129 | C | H | P | L | R | H | A | T | V | 11 |
| 40 | 133 | R | H | A | T | V | L | T | L | P | 11 |
| 41 | 177 | S | H | S | Y | C | L | H | Q | D | 11 |
| 42 | 207 | S | A | I | G | L | D | S | L | L | 11 |
| 43 | 257 | I | G | L | S | M | V | H | R | F | 11 |

HLA-B*2705 nonomers

| 1 | 194 | I | R | V | N | V | V | Y | G | L | 25 |
|---|---|---|---|---|---|---|---|---|---|---|---|
| 2 | 268 | R | R | D | S | P | L | P | V | I | 24 |
| 3 | 132 | L | R | H | A | T | V | L | T | L | 23 |
| 4 | 300 | I | R | Q | R | I | L | R | L | F | 23 |
| 5 | 305 | L | R | L | F | H | V | A | T | H | 23 |
| 6 | 231 | T | R | E | A | Q | A | K | A | F | 21 |
| 7 | 34 | C | S | L | Y | L | I | A | V | L | 18 |
| 8 | 299 | E | I | R | Q | R | I | L | R | L | 18 |
| 9 | 6 | G | N | E | S | S | A | T | Y | F | 17 |
| 10 | 66 | C | M | L | S | G | I | D | I | L | 17 |
| 11 | 162 | P | V | F | I | K | Q | L | P | F | 17 |
| 12 | 207 | S | A | I | G | L | D | S | L | L | 17 |
| 13 | 210 | G | L | D | S | L | L | I | S | F | 17 |
| 14 | 220 | Y | L | L | I | L | K | T | V | L | 17 |
| 15 | 237 | K | A | F | G | T | C | V | S | H | 17 |
| 16 | 269 | R | D | S | P | L | P | V | I | L | 17 |
| 17 | 280 | I | Y | L | L | V | P | P | V | L | 17 |
| 18 | 295 | V | K | T | K | E | I | F | Q | R | 17 |
| 19 | 11 | A | T | Y | F | I | L | I | G | L | 16 |
| 20 | 14 | F | I | L | I | G | L | P | G | L | 16 |
| 21 | 21 | G | L | E | E | A | Q | F | W | L | 16 |
| 22 | 25 | A | Q | F | W | L | A | F | P | L | 16 |
| 23 | 37 | Y | L | I | A | V | L | G | N | L | 16 |
| 24 | 92 | T | T | I | Q | F | D | A | C | L | 16 |
| 25 | 101 | L | Q | I | F | A | I | H | S | L | 16 |
| 26 | 124 | R | Y | V | A | I | C | H | P | L | 16 |
| 27 | 130 | H | P | L | R | H | A | T | V | L | 16 |
| 28 | 141 | P | R | V | T | K | I | G | V | A | 16 |
| 29 | 153 | R | G | A | A | L | M | A | P | L | 16 |
| 30 | 181 | C | L | H | Q | D | V | M | K | L | 16 |
| 31 | 201 | G | L | I | V | I | I | S | A | I | 16 |
| 32 | 203 | I | V | I | I | S | A | I | G | L | 16 |
| 33 | 216 | I | S | F | S | Y | L | L | I | L | 16 |
| 34 | 222 | L | I | L | K | T | V | L | G | L | 16 |
| 35 | 255 | P | F | I | G | L | S | M | V | H | 16 |
| 36 | 257 | I | G | L | S | M | V | H | R | F | 16 |
| 37 | 275 | V | I | L | A | N | I | Y | L | L | 16 |
| 38 | 47 | I | I | Y | I | V | R | T | E | H | 15 |
| 39 | 109 | L | S | G | M | E | S | T | V | L | 15 |
| 40 | 114 | S | T | V | L | L | A | M | A | F | 15 |
| 41 | 123 | D | R | Y | V | A | I | C | H | P | 15 |
| 42 | 145 | K | I | G | V | A | A | V | V | R | 15 |
| 43 | 156 | A | L | M | A | P | L | P | V | F | 15 |
| 44 | 168 | L | P | F | C | R | S | N | I | L | 15 |
| 45 | 172 | R | S | N | I | L | S | H | S | Y | 15 |
| 46 | 198 | V | V | Y | G | L | I | V | I | I | 15 |
| 47 | 206 | I | S | A | I | G | L | D | S | L | 15 |
| 48 | 229 | G | L | T | R | E | A | Q | A | K | 15 |
| 49 | 248 | A | V | F | I | F | Y | V | P | F | 15 |
| 50 | 251 | I | F | Y | V | P | F | I | G | L | 15 |
| 51 | 274 | P | V | I | L | A | N | I | Y | L | 15 |
| 52 | 290 | P | I | V | Y | G | V | K | T | K | 15 |
| 53 | 298 | K | E | I | R | Q | R | I | L | R | 15 |
| 54 | 19 | L | P | G | L | E | E | A | Q | F | 14 |
| 55 | 29 | L | A | F | P | L | C | S | L | Y | 14 |
| 56 | 30 | A | F | P | L | C | S | L | Y | L | 14 |
| 57 | 39 | I | A | V | L | G | N | L | T | I | 14 |
| 58 | 40 | A | V | L | G | N | L | T | I | I | 14 |
| 59 | 79 | S | M | P | K | M | L | A | I | F | 14 |
| 60 | 81 | P | K | M | L | A | I | F | W | F | 14 |
| 61 | 99 | C | L | L | Q | I | F | A | I | H | 14 |
| 62 | 137 | V | L | T | L | P | R | V | T | K | 14 |
| 63 | 138 | L | T | L | P | R | V | T | K | I | 14 |
| 64 | 150 | A | V | V | R | G | A | A | L | M | 14 |
| 65 | 160 | P | L | P | V | F | I | K | Q | L | 14 |
| 66 | 174 | N | I | L | S | H | S | Y | C | L | 14 |
| 67 | 180 | Y | C | L | H | Q | D | V | M | K | 14 |
| 68 | 192 | D | D | I | R | V | N | V | V | Y | 14 |
| 69 | 212 | D | S | L | L | I | S | F | S | Y | 14 |
| 70 | 213 | S | L | L | I | S | F | S | Y | L | 14 |
| 71 | 214 | L | L | I | S | F | S | Y | L | L | 14 |
| 72 | 260 | S | M | V | H | R | F | S | K | R | 14 |
| 73 | 263 | H | R | F | S | K | R | D | S | L | 14 |
| 74 | 267 | K | R | D | S | P | L | P | V | L | 14 |
| 75 | 293 | Y | G | V | K | T | K | E | I | R | 14 |
| 76 | 301 | R | Q | R | I | L | R | L | F | H | 14 |
| 77 | 302 | Q | R | I | L | R | L | F | H | V | 14 |
| 78 | 5 | N | G | N | E | S | S | A | T | Y | 13 |
| 79 | 23 | E | E | A | Q | F | W | L | A | F | 13 |
| 80 | 28 | W | L | A | F | P | L | C | S | L | 13 |
| 81 | 44 | N | L | T | I | I | Y | I | V | R | 13 |
| 82 | 51 | V | R | T | E | H | S | L | H | E | 13 |
| 83 | 56 | S | L | H | E | P | M | Y | I | F | 13 |
| 84 | 60 | P | M | Y | I | F | L | C | M | L | 13 |
| 85 | 72 | D | I | L | I | S | T | S | S | M | 13 |
| 86 | 74 | L | I | S | T | S | S | M | P | K | 13 |
| 87 | 75 | I | S | T | S | S | M | P | K | M | 13 |
| 88 | 98 | A | C | L | L | Q | I | F | A | I | 13 |
| 89 | 104 | F | A | I | H | S | L | S | G | M | 13 |
| 90 | 110 | S | G | M | E | S | T | V | L | L | 13 |
| 91 | 116 | V | L | L | A | M | A | F | D | R | 13 |
| 92 | 126 | V | A | I | C | H | P | L | R | H | 13 |
| 93 | 149 | A | A | V | V | R | G | A | A | L | 13 |
| 94 | 158 | M | A | P | L | P | V | F | I | K | 13 |
| 95 | 164 | F | I | K | Q | L | P | F | C | R | 13 |
| 96 | 170 | F | C | R | S | N | I | L | S | H | 13 |
| 97 | 171 | C | R | S | N | I | L | S | H | S | 13 |
| 98 | 187 | M | K | L | A | C | D | D | I | R | 13 |
| 99 | 217 | S | F | S | Y | L | L | I | L | K | 13 |
| 100 | 224 | L | K | T | V | L | G | L | T | R | 13 |
| 101 | 242 | C | V | S | H | V | C | A | V | F | 13 |
| 102 | 256 | F | I | G | L | S | M | V | H | R | 13 |
| 103 | 261 | M | V | H | R | F | S | K | R | R | 13 |
| 104 | 49 | Y | I | V | R | T | E | H | S | L | 12 |
| 105 | 57 | L | H | E | P | M | Y | I | F | L | 12 |
| 106 | 88 | W | F | N | S | T | T | I | Q | F | 12 |
| 107 | 96 | F | D | A | C | L | L | Q | I | F | 12 |
| 108 | 134 | H | A | T | V | L | T | L | P | R | 12 |
| 109 | 152 | V | R | G | A | A | L | M | A | P | 12 |
| 110 | 179 | S | Y | C | L | H | Q | D | V | M | 12 |
| 111 | 197 | N | V | V | Y | G | L | I | V | I | 12 |
| 112 | 244 | S | H | V | C | A | V | F | I | F | 12 |
| 113 | 265 | F | S | K | R | D | S | P | L | P | 12 |
| 114 | 273 | L | P | V | I | L | A | N | I | Y | 12 |
| 115 | 285 | P | P | V | L | N | P | I | V | Y | 12 |
| 116 | 288 | L | N | P | I | V | Y | G | V | K | 12 |
| 117 | 296 | K | T | K | E | I | R | Q | R | I | 12 |
| 118 | 297 | T | K | E | I | R | Q | R | I | L | 12 |

HLA-B*2709 nonomers

| 1 | 194 | I | R | V | N | V | V | Y | G | L | 24 |
|---|---|---|---|---|---|---|---|---|---|---|---|

TABLE XXVI-continued

HLA Class I Nonamers

| | POS | 1 | 2 | 3 | 4 | 5 | 6 | 7 | 8 | 9 | score |
|---|---|---|---|---|---|---|---|---|---|---|---|
| 2 | 268 | R | R | D | S | P | L | P | V | I | 24 |
| 3 | 132 | L | R | H | A | T | V | L | T | L | 22 |
| 4 | 267 | K | R | R | D | S | P | L | P | V | 21 |
| 5 | 300 | I | R | Q | R | I | L | R | L | F | 20 |
| 6 | 231 | T | R | E | A | Q | A | K | A | F | 19 |
| 7 | 302 | Q | R | I | L | R | L | F | H | V | 19 |
| 8 | 124 | R | Y | V | A | I | C | H | P | L | 16 |
| 9 | 269 | R | D | S | P | L | P | V | I | L | 16 |
| 10 | 43 | G | N | L | T | I | I | Y | I | V | 15 |
| 11 | 216 | I | S | F | S | Y | L | L | I | L | 15 |
| 12 | 11 | A | T | Y | F | I | L | I | G | L | 14 |
| 13 | 25 | A | Q | F | W | L | A | F | P | L | 14 |
| 14 | 153 | R | G | A | A | L | M | A | P | L | 14 |
| 15 | 174 | N | I | L | S | H | S | Y | C | L | 14 |
| 16 | 222 | L | I | L | K | T | V | L | G | L | 14 |
| 17 | 257 | I | G | L | S | M | V | H | R | F | 14 |
| 18 | 280 | I | Y | L | L | V | P | P | V | L | 14 |
| 19 | 6 | G | N | E | S | S | A | T | Y | F | 13 |
| 20 | 14 | F | I | L | I | G | L | P | G | L | 13 |
| 21 | 21 | G | L | E | E | A | Q | F | W | L | 13 |
| 22 | 66 | C | M | L | S | G | I | D | I | L | 13 |
| 23 | 130 | H | P | L | R | H | A | T | V | L | 13 |
| 24 | 201 | G | L | I | V | I | I | S | A | I | 13 |
| 25 | 203 | I | V | I | S | A | I | G | L | L | 13 |
| 26 | 214 | L | L | I | S | F | S | Y | L | L | 13 |
| 27 | 251 | I | F | Y | V | P | F | I | G | L | 13 |
| 28 | 263 | H | R | F | S | K | R | R | D | S | 13 |
| 29 | 275 | V | I | L | A | N | I | Y | L | L | 13 |
| 30 | 305 | L | R | L | F | H | V | A | T | H | 13 |
| 31 | 30 | A | F | P | L | C | S | L | Y | L | 12 |
| 32 | 34 | C | S | L | Y | L | I | A | V | L | 12 |
| 33 | 37 | Y | L | I | A | V | L | G | N | L | 12 |
| 34 | 51 | V | R | T | E | H | S | L | H | E | 12 |
| 35 | 60 | P | M | Y | I | F | L | C | M | L | 12 |
| 36 | 75 | I | S | T | S | S | M | P | K | M | 12 |
| 37 | 93 | T | I | Q | F | D | A | C | L | L | 12 |
| 38 | 123 | D | R | Y | V | A | I | C | H | P | 12 |
| 39 | 135 | A | T | V | L | T | L | P | R | V | 12 |
| 40 | 138 | L | T | L | P | R | V | T | K | I | 12 |
| 41 | 149 | A | A | V | V | R | G | A | A | L | 12 |
| 42 | 155 | A | A | L | M | A | P | L | P | V | 12 |
| 43 | 168 | L | P | F | C | R | S | N | I | L | 12 |
| 44 | 181 | C | L | H | Q | D | V | M | K | L | 12 |
| 45 | 188 | K | L | A | C | D | D | I | R | V | 12 |
| 46 | 190 | A | C | D | D | I | R | V | N | V | 12 |
| 47 | 195 | R | V | N | V | V | Y | G | L | I | 12 |
| 48 | 210 | G | L | D | S | L | L | I | S | F | 12 |
| 49 | 213 | S | L | L | I | S | F | S | Y | L | 12 |
| 50 | 220 | Y | L | L | I | L | K | T | V | L | 12 |
| 51 | 248 | A | V | F | I | F | Y | V | P | F | 12 |
| 52 | 279 | N | I | Y | L | L | V | P | P | V | 12 |
| 53 | 287 | V | L | N | P | I | V | Y | G | V | 12 |
| 54 | 296 | K | T | K | E | I | R | Q | R | I | 12 |
| 55 | 299 | E | I | R | Q | R | I | L | R | L | 12 |

HLA-B*5101 nonamers

| | POS | 1 | 2 | 3 | 4 | 5 | 6 | 7 | 8 | 9 | score |
|---|---|---|---|---|---|---|---|---|---|---|---|
| 1 | 39 | I | A | V | L | G | N | L | T | I | 26 |
| 2 | 31 | F | P | L | C | S | L | Y | L | I | 25 |
| 3 | 120 | M | A | F | D | R | Y | V | A | I | 24 |
| 4 | 130 | H | P | L | R | H | A | T | V | L | 23 |
| 5 | 118 | L | A | M | A | F | D | R | Y | V | 22 |
| 6 | 140 | L | P | R | V | T | K | I | G | V | 22 |
| 7 | 155 | A | A | L | M | A | P | L | P | V | 22 |
| 8 | 42 | L | G | N | L | T | I | I | Y | I | 21 |
| 9 | 254 | V | P | F | I | G | L | S | M | V | 21 |
| 10 | 284 | V | P | P | V | L | N | P | I | V | 21 |
| 11 | 168 | L | P | F | C | R | S | N | I | L | 20 |
| 12 | 235 | Q | A | K | A | F | G | T | C | V | 20 |
| 13 | 138 | L | T | L | P | R | V | T | K | I | 19 |
| 14 | 159 | A | P | L | P | V | F | I | K | Q | 18 |
| 15 | 189 | L | A | C | D | D | I | R | V | N | 18 |
| 16 | 198 | V | V | Y | G | L | I | V | I | I | 18 |
| 17 | 277 | L | A | N | I | Y | L | L | V | P | 18 |
| 18 | 207 | S | A | I | G | L | D | S | L | L | 17 |
| 19 | 283 | L | V | P | P | V | L | N | P | I | 17 |

TABLE XXVI-continued

HLA Class I Nonamers

| | POS | 1 | 2 | 3 | 4 | 5 | 6 | 7 | 8 | 9 | score |
|---|---|---|---|---|---|---|---|---|---|---|---|
| 20 | 63 | I | F | L | C | M | L | S | G | I | 16 |
| 21 | 86 | I | F | W | F | N | S | T | T | I | 16 |
| 22 | 110 | S | G | M | E | S | T | V | L | L | 16 |
| 23 | 144 | T | K | I | G | V | A | A | V | V | 16 |
| 24 | 149 | A | A | V | V | R | G | A | A | L | 16 |
| 25 | 197 | N | V | V | Y | G | L | I | V | I | 16 |
| 26 | 271 | S | P | L | P | V | I | L | A | N | 16 |
| 27 | 280 | I | Y | L | L | V | P | P | V | L | 16 |
| 28 | 3 | D | P | N | G | N | E | S | S | A | 15 |
| 29 | 40 | A | V | L | G | N | L | T | I | I | 15 |
| 30 | 97 | D | A | C | L | L | Q | I | F | A | 15 |
| 31 | 132 | L | R | H | A | T | V | L | T | L | 15 |
| 32 | 222 | L | I | L | K | T | V | L | G | L | 15 |
| 33 | 279 | N | I | Y | L | L | V | P | P | V | 15 |
| 34 | 285 | P | P | V | L | N | P | I | V | Y | 15 |
| 35 | 289 | N | P | I | V | Y | G | V | K | T | 15 |
| 36 | 9 | S | S | A | T | Y | F | I | L | I | 14 |
| 37 | 65 | L | C | M | L | S | G | I | D | I | 14 |
| 38 | 84 | L | A | I | F | W | F | N | S | T | 14 |
| 39 | 126 | V | A | I | C | H | P | L | R | H | 14 |
| 40 | 157 | L | M | A | P | L | P | V | F | I | 14 |
| 41 | 158 | M | A | P | L | P | V | F | I | K | 14 |
| 42 | 191 | C | D | D | I | R | V | N | V | V | 14 |
| 43 | 200 | Y | G | L | I | V | I | I | S | A | 14 |
| 44 | 209 | L | G | L | D | S | L | I | S | S | 14 |
| 45 | 215 | L | I | S | F | S | Y | L | L | I | 14 |
| 46 | 219 | S | Y | L | L | I | L | K | T | V | 14 |
| 47 | 220 | Y | L | L | I | L | K | T | V | L | 14 |
| 48 | 237 | K | A | F | G | T | C | V | S | H | 14 |
| 49 | 247 | C | A | V | F | I | F | Y | V | P | 14 |
| 50 | 249 | V | F | I | F | Y | V | P | F | I | 14 |
| 51 | 251 | I | F | Y | V | P | F | I | G | L | 14 |
| 52 | 257 | I | G | L | S | M | V | H | R | F | 14 |
| 53 | 268 | R | R | D | S | P | L | P | V | I | 14 |
| 54 | 273 | L | P | V | I | L | A | N | I | Y | 14 |
| 55 | 29 | L | A | F | P | L | C | S | L | Y | 13 |
| 56 | 33 | L | C | S | L | Y | L | I | A | V | 13 |
| 57 | 55 | H | S | L | H | E | P | M | Y | I | 13 |
| 58 | 67 | M | L | S | G | I | D | I | L | I | 13 |
| 59 | 80 | M | P | K | M | L | A | I | F | W | 13 |
| 60 | 95 | Q | F | D | A | C | L | L | Q | I | 13 |
| 61 | 98 | A | C | L | L | Q | I | F | A | I | 13 |
| 62 | 104 | F | A | I | H | S | L | S | G | M | 13 |
| 63 | 146 | I | G | V | A | A | V | V | R | G | 13 |
| 64 | 148 | V | A | A | V | V | R | G | A | A | 13 |
| 65 | 153 | R | G | A | A | L | M | A | P | L | 13 |
| 66 | 233 | E | A | Q | A | K | A | F | G | T | 13 |
| 67 | 243 | V | S | H | V | C | A | V | F | I | 13 |
| 68 | 292 | V | Y | G | V | K | T | K | E | I | 13 |
| 69 | 296 | K | T | K | E | I | R | Q | R | I | 13 |

TABLE XXVII

HLA Class I decamers

| | Pos | 1 | 2 | 3 | 4 | 5 | 6 | 7 | 8 | 9 | 0 | score |
|---|---|---|---|---|---|---|---|---|---|---|---|---|

HLA-A1 decamers

| | | | | | | | | | | | | |
|---|---|---|---|---|---|---|---|---|---|---|---|---|
| 1 | 191 | C | <u>D</u> | D | I | R | V | <u>N</u> | V | V | Y | 27 |
| 2 | 244 | S | <u>H</u> | V | C | A | V | <u>F</u> | I | F | Y | 24 |
| 3 | 40 | A | <u>V</u> | L | G | N | L | <u>T</u> | I | I | Y | 21 |
| 4 | 284 | V | <u>P</u> | P | V | L | N | <u>P</u> | I | V | Y | 21 |
| 5 | 116 | V | <u>L</u> | L | A | M | A | <u>F</u> | D | R | Y | 20 |
| 6 | 28 | W | <u>L</u> | A | F | P | L | <u>C</u> | S | L | Y | 18 |
| 7 | 297 | T | <u>K</u> | E | I | R | Q | <u>R</u> | I | L | R | 17 |
| 8 | 21 | G | <u>L</u> | E | E | A | Q | <u>F</u> | W | L | A | 16 |
| 9 | 22 | L | <u>E</u> | E | A | Q | F | <u>W</u> | L | A | F | 16 |
| 10 | 52 | R | <u>T</u> | E | H | S | L | <u>H</u> | E | P | M | 16 |
| 11 | 53 | T | <u>E</u> | H | S | L | H | <u>E</u> | P | M | Y | 16 |
| 12 | 57 | L | <u>H</u> | E | P | M | Y | <u>I</u> | F | L | C | 16 |
| 13 | 111 | G | <u>M</u> | E | S | T | V | <u>L</u> | L | A | M | 16 |

TABLE XXVII-continued

HLA Class I decamers

| | Pos | 1 | 2 | 3 | 4 | 5 | 6 | 7 | 8 | 9 | 0 | score |
|---|---|---|---|---|---|---|---|---|---|---|---|---|
| 14 | 272 | P | L | P | V | I | L | A | N | I | Y | 16 |
| 15 | 1 | M | V | D | P | N | G | N | E | S | S | 15 |
| 16 | 4 | P | N | G | N | E | S | S | A | T | Y | 15 |
| 17 | 121 | A | F | D | R | Y | V | A | I | C | H | 15 |
| 18 | 171 | C | R | S | N | I | L | S | H | S | Y | 15 |
| 19 | 211 | L | D | S | L | L | I | S | F | S | Y | 15 |
| 20 | 8 | E | S | S | A | T | Y | F | I | L | I | 13 |
| 21 | 190 | A | C | D | D | I | R | V | N | V | V | 13 |

HLA-A*0201 decamers

| | Pos | 1 | 2 | 3 | 4 | 5 | 6 | 7 | 8 | 9 | 0 | score |
|---|---|---|---|---|---|---|---|---|---|---|---|---|
| 1 | 221 | L | L | I | L | K | T | V | L | G | L | 30 |
| 2 | 100 | L | L | Q | I | F | A | I | H | S | L | 29 |
| 3 | 282 | L | L | V | P | P | V | L | N | P | I | 27 |
| 4 | 205 | I | I | S | A | I | G | L | D | S | L | 26 |
| 5 | 213 | S | L | L | I | S | F | S | Y | L | L | 25 |
| 6 | 56 | S | L | H | E | P | M | Y | I | F | L | 24 |
| 7 | 62 | Y | I | F | L | C | M | L | S | G | I | 24 |
| 8 | 108 | S | L | S | G | M | E | S | T | V | L | 24 |
| 9 | 117 | L | L | A | M | A | F | D | R | Y | V | 24 |
| 10 | 131 | P | L | R | H | A | T | V | L | T | L | 24 |
| 11 | 137 | V | L | T | L | P | R | V | T | K | I | 24 |
| 12 | 215 | L | I | S | F | S | Y | L | L | I | L | 24 |
| 13 | 38 | L | I | A | V | L | G | N | L | T | I | 23 |
| 14 | 41 | V | L | G | N | L | T | I | I | Y | I | 23 |
| 15 | 156 | A | L | M | A | P | L | V | V | F | I | 23 |
| 16 | 193 | D | I | R | V | N | V | V | Y | G | L | 23 |
| 17 | 214 | L | L | I | S | F | S | Y | L | L | I | 23 |
| 18 | 32 | P | L | C | S | L | Y | L | I | A | V | 22 |
| 19 | 119 | A | M | A | F | D | R | Y | V | A | I | 22 |
| 20 | 237 | K | A | F | G | T | C | V | S | H | V | 22 |
| 21 | 275 | V | I | L | A | N | I | Y | L | L | V | 22 |
| 22 | 85 | A | I | F | W | F | N | S | T | T | I | 21 |
| 23 | 139 | T | L | P | R | V | T | K | I | G | V | 21 |
| 24 | 202 | L | I | V | I | I | S | A | I | G | L | 21 |
| 25 | 13 | Y | F | I | L | I | G | L | P | G | L | 20 |
| 26 | 16 | L | I | G | L | P | G | L | E | E | A | 20 |
| 27 | 29 | L | A | F | P | L | C | S | L | Y | L | 20 |
| 28 | 142 | R | V | T | K | I | G | V | A | A | V | 20 |
| 29 | 148 | V | A | A | V | V | R | G | A | A | L | 20 |
| 30 | 167 | Q | L | P | F | C | R | S | N | I | L | 20 |
| 31 | 180 | Y | C | L | H | Q | D | V | M | K | L | 20 |
| 32 | 222 | L | I | L | K | T | V | L | G | L | T | 20 |
| 33 | 240 | G | T | C | V | S | H | V | C | A | V | 20 |
| 34 | 248 | A | V | F | I | F | Y | V | P | F | I | 20 |
| 35 | 250 | F | I | F | Y | V | P | F | I | G | L | 20 |
| 36 | 271 | S | P | L | P | V | I | L | A | N | I | 20 |
| 37 | 279 | N | I | Y | L | L | V | P | P | V | L | 20 |
| 38 | 304 | I | L | R | L | F | H | V | A | T | H | 20 |
| 39 | 10 | S | A | T | Y | F | I | L | I | G | L | 19 |
| 40 | 15 | I | L | I | G | L | P | G | L | E | E | 19 |
| 41 | 27 | F | W | L | A | F | P | L | C | S | L | 19 |
| 42 | 35 | S | L | Y | L | I | A | V | L | G | N | 19 |
| 43 | 37 | Y | L | I | A | V | L | G | N | L | T | 19 |
| 44 | 44 | N | L | T | I | I | Y | I | V | R | I | 19 |
| 45 | 64 | F | L | C | M | L | S | G | I | D | I | 19 |
| 46 | 83 | M | L | A | I | F | W | F | N | S | T | 19 |
| 47 | 159 | A | P | L | P | V | F | I | K | Q | L | 19 |
| 48 | 189 | L | A | C | D | D | I | R | V | N | V | 19 |
| 49 | 207 | S | A | I | G | L | D | S | L | L | I | 19 |
| 50 | 253 | Y | V | P | F | I | G | L | S | M | V | 19 |
| 51 | 276 | I | L | A | N | I | Y | L | L | V | P | 19 |
| 52 | 281 | Y | L | L | V | P | P | V | L | N | P | 19 |
| 53 | 283 | L | V | P | P | V | L | N | P | I | V | 19 |
| 54 | 286 | P | V | L | N | P | I | V | Y | G | V | 19 |
| 55 | 33 | L | C | S | L | Y | L | I | A | V | L | 18 |
| 56 | 36 | L | Y | L | I | A | V | L | G | N | L | 18 |
| 57 | 39 | I | A | V | L | G | N | L | T | I | I | 18 |
| 58 | 42 | L | G | N | L | T | I | I | Y | I | V | 18 |
| 59 | 66 | C | M | L | S | G | I | D | I | L | I | 18 |
| 60 | 111 | G | M | E | S | T | V | L | L | A | M | 18 |
| 61 | 128 | I | C | H | P | L | R | H | A | T | V | 18 |
| 62 | 134 | H | A | T | V | L | T | L | P | R | V | 18 |
| 63 | 154 | G | A | A | L | M | A | P | L | P | V | 18 |
| 64 | 157 | L | M | A | P | L | P | V | F | I | K | 18 |
| 65 | 190 | A | C | D | D | I | R | V | N | V | V | 18 |
| 66 | 229 | G | L | T | R | E | A | Q | A | K | A | 18 |
| 67 | 245 | H | V | C | A | V | F | I | F | Y | V | 18 |
| 68 | 274 | P | V | I | L | A | N | I | Y | L | L | 18 |
| 69 | 278 | A | N | I | Y | L | L | V | P | P | V | 18 |
| 70 | 291 | I | V | Y | G | V | K | T | K | E | I | 18 |
| 71 | 298 | K | E | I | R | Q | R | I | L | R | L | 18 |
| 72 | 48 | I | Y | I | V | R | T | E | H | S | L | 17 |
| 73 | 65 | L | C | M | L | S | G | I | D | I | L | 17 |
| 74 | 67 | M | L | S | G | I | D | I | L | I | S | 17 |
| 75 | 74 | L | I | S | T | S | S | M | P | K | M | 17 |
| 76 | 91 | S | T | T | I | Q | F | D | A | C | L | 17 |
| 77 | 94 | I | Q | F | D | A | C | L | L | Q | I | 17 |
| 78 | 188 | K | L | A | C | D | D | I | R | V | N | 17 |
| 79 | 197 | N | V | V | Y | G | L | I | V | I | I | 17 |
| 80 | 200 | Y | G | L | I | V | I | I | S | A | I | 17 |
| 81 | 218 | F | S | Y | L | L | I | L | K | T | V | 17 |
| 82 | 227 | V | L | G | L | T | R | E | A | Q | A | 17 |
| 83 | 303 | R | I | L | R | L | F | H | V | A | T | 17 |
| 84 | 21 | G | L | E | E | A | Q | F | W | L | A | 16 |
| 85 | 92 | T | T | I | Q | F | D | A | C | L | L | 16 |
| 86 | 97 | D | A | C | L | L | Q | I | F | A | I | 16 |
| 87 | 127 | A | I | C | H | P | L | R | H | A | T | 16 |
| 88 | 143 | V | T | K | I | G | V | A | A | V | V | 16 |
| 89 | 195 | R | V | N | V | V | Y | G | L | I | V | 16 |
| 90 | 220 | Y | L | L | I | L | K | T | V | L | G | 16 |
| 91 | 296 | K | T | K | E | I | R | Q | R | I | L | 16 |
| 92 | 18 | G | L | P | G | L | E | E | A | Q | F | 15 |
| 93 | 30 | A | F | P | L | C | S | L | Y | L | I | 15 |
| 94 | 126 | V | A | I | C | H | P | L | R | H | A | 15 |
| 95 | 145 | K | I | G | V | A | A | V | V | R | G | 15 |
| 96 | 173 | S | N | I | L | S | H | S | Y | C | L | 15 |
| 97 | 201 | G | L | I | V | I | I | S | A | I | G | 15 |
| 98 | 208 | A | I | G | L | D | S | L | L | I | S | 15 |
| 99 | 210 | G | L | D | S | L | L | I | S | F | S | 15 |
| 100 | 267 | K | R | R | D | S | P | L | P | V | I | 15 |

HLA-A*0203 decamers

| | Pos | 1 | 2 | 3 | 4 | 5 | 6 | 7 | 8 | 9 | 0 | score |
|---|---|---|---|---|---|---|---|---|---|---|---|---|
| 1 | 141 | P | R | V | T | K | I | G | V | A | A | 19 |
| 2 | 147 | G | V | A | A | V | V | R | G | A | A | 19 |
| 3 | 112 | M | E | S | T | V | L | L | A | M | A | 18 |
| 4 | 227 | V | L | G | L | T | R | E | A | Q | A | 18 |
| 5 | 229 | G | L | T | R | E | A | Q | A | K | A | 18 |
| 6 | 142 | R | V | T | K | I | G | V | A | A | V | 17 |
| 7 | 148 | V | A | A | V | V | R | G | A | A | L | 17 |
| 8 | 2 | L | D | P | N | G | N | E | S | S | A | 10 |
| 9 | 16 | L | I | G | L | P | G | L | E | E | A | 10 |
| 10 | 21 | G | L | E | E | A | Q | F | W | L | A | 10 |
| 11 | 31 | F | P | L | C | S | L | Y | L | I | A | 10 |
| 12 | 76 | S | T | S | S | M | P | K | M | L | A | 10 |
| 13 | 89 | N | S | T | T | I | Q | F | D | A | 10 | |

| 13 | 89 | N | S | T | T | I | Q | F | D | A | 10 |
| 14 | 96 | F | D | A | C | L | L | Q | I | F | A | 10 |
| 15 | 110 | S | G | M | E | S | T | V | L | L | A | 10 |
| 16 | 118 | L | A | M | A | F | D | R | Y | V | A | 10 |
| 17 | 126 | V | A | I | C | H | P | L | R | H | A | 10 |
| 18 | 140 | L | P | R | V | T | K | I | G | V | A | 10 |
| 19 | 146 | I | G | V | A | A | V | V | R | G | A | 10 |
| 20 | 150 | A | V | V | R | G | A | A | L | M | A | 10 |
| 21 | 181 | C | L | H | Q | D | V | M | K | L | A | 10 |
| 22 | 199 | V | Y | G | L | I | V | I | I | S | A | 10 |
| 23 | 225 | K | T | V | L | G | L | T | R | E | A | 10 |
| 24 | 239 | F | G | T | C | V | S | H | V | C | A | 10 |
| 25 | 269 | R | D | S | P | L | P | V | I | L | A | 10 |
| 26 | 302 | Q | R | I | L | R | L | F | H | V | A | 10 |
| 27 | 305 | L | R | L | F | H | V | A | T | H | A | 10 |
| 28 | 3 | D | P | N | G | N | E | S | S | A | T | 9 |
| 29 | 17 | I | G | L | P | G | L | E | E | A | Q | 9 |
| 30 | 22 | L | E | E | A | Q | F | W | L | A | F | 9 |
| 31 | 32 | P | L | C | S | L | Y | L | I | A | V | 9 |
| 32 | 77 | T | S | S | M | P | K | M | L | A | I | 9 |
| 33 | 90 | N | T | T | I | Q | F | D | A | C | L | 9 |
| 34 | 97 | D | A | C | L | L | Q | I | F | A | I | 9 |
| 35 | 111 | G | M | E | S | T | V | L | L | A | M | 9 |
| 36 | 113 | E | S | T | V | L | L | A | M | A | F | 9 |
| 37 | 119 | A | M | A | F | D | R | Y | V | A | I | 9 |
| 38 | 127 | A | I | C | H | P | L | R | H | A | T | 9 |

TABLE XXVII-continued

HLA Class I decamers

| | Pos | 1 | 2 | 3 | 4 | 5 | 6 | 7 | 8 | 9 | 0 | score |
|---|---|---|---|---|---|---|---|---|---|---|---|---|
| 39 | 151 | V | V | R | G | A | A | L | M | A | P | 9 |
| 40 | 182 | L | H | Q | D | V | M | K | L | A | C | 9 |
| 41 | 200 | Y | G | L | I | V | I | I | S | A | I | 9 |
| 42 | 226 | T | V | L | G | L | T | R | E | A | Q | 9 |
| 43 | 228 | L | G | L | T | R | E | A | Q | A | K | 9 |
| 44 | 230 | L | T | R | E | A | Q | A | K | A | F | 9 |
| 45 | 240 | G | T | C | V | S | H | V | C | A | V | 9 |
| 46 | 270 | D | S | P | L | P | V | I | L | A | N | 9 |
| 47 | 303 | R | I | L | R | L | F | H | V | A | T | 9 |
| 48 | 306 | R | L | F | H | V | A | T | H | A | S | 9 |

HLA-A26 decamers

| | Pos | 1 | 2 | 3 | 4 | 5 | 6 | 7 | 8 | 9 | 0 | score |
|---|---|---|---|---|---|---|---|---|---|---|---|---|
| 1 | 299 | E | I | R | Q | R | I | L | R | L | F | 31 |
| 2 | 193 | D | I | R | V | N | V | V | Y | G | L | 29 |
| 3 | 250 | F | I | F | Y | V | P | F | I | G | L | 25 |
| 4 | 256 | F | I | G | L | S | M | V | H | R | F | 25 |
| 5 | 74 | L | I | S | T | S | S | M | P | K | M | 24 |
| 6 | 274 | P | V | I | L | A | N | I | Y | L | L | 24 |
| 7 | 18 | G | L | P | G | L | E | E | A | Q | F | 23 |
| 8 | 116 | V | L | L | A | M | A | F | D | R | Y | 23 |
| 9 | 205 | I | I | S | A | I | G | L | D | S | L | 23 |
| 10 | 221 | L | L | I | L | K | T | V | L | G | L | 23 |
| 11 | 230 | L | T | R | E | A | Q | A | K | A | F | 23 |
| 12 | 13 | Y | F | I | L | I | G | L | P | G | L | 22 |
| 13 | 40 | A | V | L | G | N | L | T | I | I | Y | 22 |
| 14 | 56 | S | L | H | E | P | M | Y | I | F | L | 22 |
| 15 | 95 | Q | F | D | A | C | L | L | Q | I | F | 22 |
| 16 | 215 | L | I | S | F | S | Y | L | L | I | L | 22 |
| 17 | 92 | T | T | I | Q | F | D | A | C | L | L | 21 |
| 18 | 100 | L | L | Q | I | F | A | I | H | S | L | 21 |
| 19 | 103 | I | F | A | I | H | S | L | S | G | M | 21 |
| 20 | 296 | K | T | K | E | I | R | Q | R | I | L | 21 |
| 21 | 28 | W | L | A | F | P | L | C | S | L | Y | 20 |
| 22 | 131 | P | L | R | H | A | T | V | L | T | L | 20 |
| 23 | 59 | E | P | M | Y | I | F | L | C | M | L | 19 |
| 24 | 91 | S | T | T | I | Q | F | D | A | C | L | 19 |
| 25 | 202 | L | I | V | I | I | S | A | I | G | L | 19 |
| 26 | 212 | D | S | L | L | I | S | F | S | Y | L | 19 |
| 27 | 272 | P | L | P | V | I | L | A | N | I | Y | 19 |
| 28 | 279 | N | I | Y | L | L | V | P | P | V | L | 19 |
| 29 | 52 | R | T | E | H | S | L | H | E | P | M | 18 |
| 30 | 62 | Y | I | F | L | C | M | L | S | G | I | 18 |
| 31 | 72 | D | I | L | I | S | T | S | S | M | P | 18 |
| 32 | 108 | S | L | S | G | M | E | S | T | V | L | 18 |
| 33 | 113 | E | S | T | V | L | L | A | M | A | F | 18 |
| 34 | 151 | V | V | R | G | A | A | L | M | A | P | 18 |
| 35 | 78 | S | S | M | P | K | M | L | A | I | F | 17 |
| 36 | 142 | R | V | T | K | I | G | V | A | A | V | 17 |
| 37 | 162 | P | V | F | I | K | Q | L | P | F | C | 17 |
| 38 | 164 | F | I | K | Q | L | P | F | C | R | S | 17 |
| 39 | 167 | Q | L | P | F | C | R | S | N | I | L | 17 |
| 40 | 185 | D | V | M | K | L | A | C | D | D | I | 17 |
| 41 | 248 | A | V | F | I | F | Y | V | P | F | I | 17 |
| 42 | 253 | Y | V | P | F | I | G | L | S | M | V | 17 |
| 43 | 45 | L | T | I | I | Y | I | V | R | T | E | 16 |
| 44 | 145 | K | I | G | V | A | A | V | R | G | 16 |
| 45 | 198 | V | V | Y | G | L | I | V | I | I | S | 16 |
| 46 | 203 | I | V | I | I | S | A | I | G | L | D | 16 |
| 47 | 209 | I | G | L | D | S | L | L | I | S | F | 16 |
| 48 | 213 | S | L | L | I | S | F | S | Y | L | L | 16 |
| 49 | 255 | P | F | I | G | L | S | M | V | H | R | 16 |
| 50 | 264 | R | F | S | K | R | R | D | S | P | L | 16 |
| 51 | 294 | G | V | K | T | K | E | I | R | Q | R | 16 |
| 52 | 16 | L | I | G | L | P | G | L | E | E | A | 15 |
| 53 | 80 | M | P | K | M | L | A | I | F | W | F | 15 |
| 54 | 114 | S | T | V | L | L | A | M | A | F | D | 15 |
| 55 | 155 | A | A | L | M | A | P | L | P | V | F | 15 |
| 56 | 159 | A | P | L | P | V | F | I | K | Q | L | 15 |
| 57 | 174 | N | I | L | S | H | S | Y | C | L | H | 15 |
| 58 | 197 | N | V | V | Y | G | L | I | V | I | I | 15 |
| 59 | 210 | G | L | D | S | L | L | I | S | F | S | 15 |
| 60 | 214 | L | L | I | S | F | S | Y | L | L | I | 15 |
| 61 | 222 | L | I | L | K | T | V | L | G | L | T | 15 |
| 62 | 240 | G | T | C | V | S | H | V | C | A | V | 15 |
| 63 | 247 | C | A | V | F | I | F | Y | V | P | F | 15 |
| 64 | 286 | P | V | L | N | P | I | V | Y | G | V | 15 |
| 65 | 298 | K | E | I | R | Q | R | I | L | R | L | 15 |

HLA-A3 decamers

| | Pos | 1 | 2 | 3 | 4 | 5 | 6 | 7 | 8 | 9 | 0 | score |
|---|---|---|---|---|---|---|---|---|---|---|---|---|
| 1 | 136 | T | V | L | T | L | P | R | V | T | K | 31 |
| 2 | 287 | V | L | N | P | I | V | Y | G | V | K | 28 |
| 3 | 223 | I | L | K | T | V | L | G | L | T | R | 27 |
| 4 | 304 | I | L | R | L | F | H | V | A | T | H | 27 |
| 5 | 73 | I | L | I | S | T | S | S | M | P | K | 26 |
| 6 | 15 | I | L | I | G | L | P | G | L | E | E | 23 |
| 7 | 40 | A | V | L | G | N | L | T | I | I | Y | 23 |
| 8 | 150 | A | V | R | G | A | A | L | M | A | 23 |
| 9 | 258 | G | L | S | M | V | H | R | F | S | K | 23 |
| 10 | 18 | G | L | P | G | L | E | E | A | Q | F | 22 |
| 11 | 303 | R | I | L | R | L | F | H | V | A | T | 22 |
| 12 | 276 | I | L | A | N | I | Y | L | L | V | P | 21 |
| 13 | 28 | W | L | A | F | P | L | C | S | L | Y | 20 |
| 14 | 115 | T | V | L | L | A | M | A | F | D | R | 20 |
| 15 | 116 | V | L | L | A | M | A | F | D | R | Y | 20 |
| 16 | 125 | Y | V | A | I | C | H | P | L | R | H | 20 |
| 17 | 131 | P | L | R | H | A | T | V | L | T | L | 20 |
| 18 | 144 | T | K | I | G | V | A | A | V | V | R | 20 |
| 19 | 156 | A | L | M | A | P | L | P | V | F | I | 20 |
| 20 | 195 | R | V | N | V | V | Y | G | L | I | V | 20 |
| 21 | 35 | S | L | Y | L | I | A | N | I | G | N | 19 |
| 22 | 272 | P | L | P | V | I | L | A | N | I | Y | 19 |
| 23 | 37 | Y | L | I | A | V | L | G | N | L | T | 18 |
| 24 | 49 | Y | I | V | R | T | E | H | S | L | H | 18 |
| 25 | 50 | I | V | R | T | E | H | S | L | H | E | 18 |
| 26 | 108 | S | L | S | G | M | E | S | T | V | L | 18 |
| 27 | 142 | R | V | T | K | I | G | V | A | A | V | 18 |
| 28 | 188 | K | A | C | D | D | I | R | V | N | 18 |
| 29 | 279 | N | I | Y | L | L | V | P | P | V | L | 18 |
| 30 | 291 | I | V | Y | G | V | K | T | K | E | I | 18 |
| 31 | 294 | G | V | K | T | K | E | I | R | Q | R | 18 |
| 32 | 46 | T | I | I | Y | I | V | R | T | E | H | 17 |
| 33 | 102 | Q | I | F | A | I | H | S | L | S | G | 17 |
| 34 | 151 | V | V | R | G | A | A | L | M | A | P | 17 |
| 35 | 179 | S | Y | C | L | H | Q | D | V | M | K | 17 |
| 36 | 203 | I | V | I | I | S | A | I | G | L | D | 17 |
| 37 | 204 | V | I | I | S | A | I | G | L | D | S | 17 |
| 38 | 220 | Y | L | L | I | L | K | T | V | L | G | 17 |
| 39 | 221 | L | L | I | L | K | T | V | L | G | L | 17 |
| 40 | 227 | V | L | G | L | T | R | E | A | Q | A | 17 |
| 41 | 242 | C | V | S | H | V | C | A | V | F | I | 17 |
| 42 | 289 | N | P | I | V | Y | G | V | K | T | K | 17 |
| 43 | 38 | L | I | A | V | L | G | N | L | T | I | 16 |
| 44 | 85 | A | I | F | W | F | N | S | T | T | I | 16 |
| 45 | 147 | G | V | A | A | V | R | G | A | A | L | 16 |
| 46 | 198 | V | V | Y | G | L | I | V | I | I | S | 16 |
| 47 | 201 | G | L | I | V | I | I | S | A | I | G | 16 |
| 48 | 214 | L | L | I | S | F | S | Y | L | L | I | 16 |
| 49 | 226 | T | V | L | G | L | T | R | E | A | Q | 16 |
| 50 | 228 | L | G | L | T | R | E | A | Q | A | K | 16 |
| 51 | 229 | G | L | T | R | E | A | Q | A | K | A | 16 |
| 52 | 1 | M | V | D | P | N | G | N | E | S | S | 15 |
| 53 | 44 | N | L | T | I | I | Y | I | V | R | T | 15 |
| 54 | 47 | I | I | Y | I | V | R | T | E | H | S | 15 |
| 55 | 67 | M | L | S | G | I | D | T | L | I | S | 15 |
| 56 | 72 | D | I | L | I | S | T | S | S | M | P | 15 |
| 57 | 99 | C | L | Q | I | F | A | I | H | S | 15 |
| 58 | 105 | A | I | H | S | L | S | G | M | E | S | 15 |
| 59 | 145 | K | I | G | V | A | A | V | R | G | 15 |
| 60 | 175 | I | L | S | H | S | Y | C | L | H | Q | 15 |
| 61 | 191 | C | D | D | I | R | V | N | V | V | Y | 15 |
| 62 | 208 | A | I | G | L | D | S | L | L | I | S | 15 |
| 63 | 275 | V | I | L | A | N | I | Y | L | L | V | 15 |
| 64 | 281 | Y | L | L | V | P | P | V | L | N | P | 15 |
| 65 | 299 | E | I | R | Q | R | I | L | R | L | F | 15 |
| 66 | 306 | R | L | F | H | V | A | T | H | A | S | 15 |

HLA-B*0702 decamers

| | Pos | 1 | 2 | 3 | 4 | 5 | 6 | 7 | 8 | 9 | 0 | score |
|---|---|---|---|---|---|---|---|---|---|---|---|---|
| 1 | 159 | A | P | L | P | V | F | I | K | Q | L | 23 |
| 2 | 59 | E | P | M | Y | I | F | L | C | M | L | 22 |
| 3 | 273 | L | P | V | I | L | A | N | I | Y | L | 20 |

TABLE XXVII-continued

HLA Class I decamers

| | Pos | 1 | 2 | 3 | 4 | 5 | 6 | 7 | 8 | 9 | 0 | score |
|---|---|---|---|---|---|---|---|---|---|---|---|---|
| 4 | 3 | D | P | N | G | N | E | S | S | A | T | 19 |
| 5 | 130 | H | P | L | R | H | A | T | V | L | T | 19 |
| 6 | 140 | L | P | R | V | T | K | I | G | V | A | 19 |
| 7 | 161 | L | P | V | F | I | K | Q | L | P | F | 19 |
| 8 | 31 | F | P | L | C | S | L | Y | L | I | A | 18 |
| 9 | 271 | S | P | L | P | V | I | L | A | N | I | 18 |
| 10 | 80 | M | P | K | M | L | A | I | F | W | F | 16 |
| 11 | 108 | S | L | S | G | M | E | S | T | V | L | 16 |
| 12 | 131 | P | L | R | H | A | T | V | L | T | L | 15 |
| 13 | 264 | R | F | S | K | R | R | D | S | P | L | 15 |
| 14 | 33 | L | C | S | L | Y | L | I | A | V | L | 14 |
| 15 | 109 | L | S | G | M | E | S | T | V | L | L | 14 |
| 16 | 152 | V | R | G | A | A | L | M | A | P | L | 14 |
| 17 | 205 | I | I | S | A | I | G | L | D | S | L | 14 |
| 18 | 215 | L | I | S | F | S | Y | L | L | I | L | 14 |
| 19 | 268 | R | R | D | S | P | L | P | V | I | L | 14 |
| 20 | 29 | L | A | F | P | L | C | S | L | Y | L | 13 |
| 21 | 148 | V | A | A | V | V | R | G | A | A | L | 13 |
| 22 | 156 | A | L | M | A | P | L | P | V | F | I | 13 |
| 23 | 193 | D | I | R | V | N | V | V | Y | G | L | 13 |
| 24 | 221 | L | L | I | L | K | T | V | L | G | L | 13 |
| 25 | 298 | K | E | I | R | Q | R | I | L | R | L | 13 |
| 26 | 7 | N | E | S | S | A | T | Y | F | I | L | 12 |
| 27 | 19 | L | P | G | L | E | E | A | Q | F | W | 12 |
| 28 | 24 | E | A | Q | F | W | L | A | F | P | L | 12 |
| 29 | 119 | A | M | A | F | D | R | Y | V | A | I | 12 |
| 30 | 129 | C | H | P | L | R | H | A | T | V | L | 12 |
| 31 | 206 | I | S | A | I | G | L | D | S | L | L | 12 |
| 32 | 219 | S | Y | L | L | I | L | K | T | V | L | 12 |
| 33 | 279 | N | I | Y | L | L | V | P | P | V | L | 12 |
| 34 | 285 | P | P | V | L | N | P | I | V | Y | G | 12 |
| 35 | 8 | E | S | S | A | T | Y | F | I | L | I | 11 |
| 36 | 13 | Y | F | I | L | I | G | L | P | G | L | 11 |
| 37 | 27 | F | W | L | A | F | P | L | C | S | L | 11 |
| 38 | 48 | I | Y | I | V | R | T | E | H | S | L | 11 |

TABLE XXVII-continued

HLA Class I decamers

| | Pos | 1 | 2 | 3 | 4 | 5 | 6 | 7 | 8 | 9 | 0 | score |
|---|---|---|---|---|---|---|---|---|---|---|---|---|
| 39 | 56 | S | L | H | E | P | M | Y | I | F | L | 11 |
| 40 | 65 | L | C | M | L | S | G | I | D | I | L | 11 |
| 41 | 75 | I | S | T | S | S | M | P | K | M | L | 11 |
| 42 | 77 | T | S | S | M | P | K | M | L | A | I | 11 |
| 43 | 91 | S | T | T | I | Q | F | D | A | C | L | 11 |
| 44 | 123 | D | R | Y | V | A | I | C | H | P | L | 11 |
| 45 | 142 | R | V | T | K | I | G | V | A | A | V | 11 |
| 46 | 180 | Y | C | L | H | Q | D | V | M | K | L | 11 |
| 47 | 190 | A | C | D | D | I | R | V | N | V | V | 11 |
| 48 | 212 | D | S | L | L | I | S | F | S | Y | L | 11 |
| 49 | 234 | A | Q | A | K | A | F | G | T | C | V | 11 |
| 50 | 242 | C | V | S | H | V | C | A | V | F | I | 11 |
| 51 | 248 | A | V | F | I | F | Y | V | P | F | I | 11 |
| 52 | 250 | F | I | F | Y | V | P | F | I | G | L | 11 |
| 53 | 254 | V | P | F | I | G | L | S | M | V | H | 11 |
| 54 | 266 | S | K | R | R | D | S | P | L | P | V | 11 |
| 55 | 267 | K | R | R | D | S | P | L | P | V | I | 11 |
| 56 | 269 | R | D | S | P | L | P | V | I | L | A | 11 |
| 57 | 278 | A | N | I | Y | L | L | V | P | P | V | 11 |
| 58 | 284 | V | P | P | V | L | N | P | I | V | Y | 11 |
| 59 | 289 | N | P | I | V | Y | G | V | K | T | K | 11 |
| 60 | 296 | K | T | K | E | I | R | Q | R | I | L | 11 |

TABLE XXVIII

HLA Class II Epitopes (sample 15-mer length)

| | Pos | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| | | | | | | HLA-DRB1*0101 15-mers | | | | | | | | | | | |
| 1 | 200 | Y | G | L | I | V | I | I | S | A | I | G | L | D | S | L | 36 |
| 2 | 68 | L | S | G | I | D | I | L | I | S | T | S | S | M | P | K | 34 |
| 3 | 62 | Y | I | F | L | C | M | L | S | G | I | D | I | L | I | S | 33 |
| 4 | 103 | I | F | A | I | H | S | L | S | G | M | E | S | T | V | L | 32 |
| 5 | 45 | L | T | I | I | Y | I | V | R | T | E | H | S | L | H | E | 31 |
| 6 | 193 | D | I | R | V | N | V | V | Y | G | L | I | V | I | I | S | 31 |
| 7 | 277 | L | A | N | I | Y | L | L | V | P | P | V | L | N | P | I | 31 |
| 8 | 97 | D | A | C | L | L | Q | I | F | A | I | H | S | L | S | G | 30 |
| 9 | 106 | I | H | S | L | S | G | M | E | S | T | V | L | L | A | M | 30 |
| 10 | 240 | G | T | C | V | S | H | V | C | A | V | F | I | F | Y | V | 30 |
| 11 | 10 | S | A | T | Y | F | I | L | I | G | L | P | G | L | E | E | 29 |
| 12 | 289 | N | P | I | V | Y | G | V | K | T | K | E | I | R | Q | R | 29 |
| 13 | 11 | A | T | Y | F | I | L | I | G | L | P | G | L | E | E | A | 28 |
| 14 | 250 | F | I | F | Y | V | P | F | I | G | L | S | M | V | H | R | 27 |
| 15 | 140 | L | P | R | V | T | K | I | G | V | A | A | V | V | R | G | 26 |
| 16 | 183 | H | Q | D | V | M | K | L | A | C | D | D | I | R | V | N | 26 |
| 17 | 217 | S | F | S | Y | L | L | I | L | K | T | V | L | G | L | T | 26 |
| 18 | 16 | L | I | G | L | P | G | L | E | E | A | Q | F | W | L | A | 25 |
| 19 | 24 | E | A | Q | F | W | L | A | F | P | L | C | S | L | Y | L | 25 |
| 20 | 36 | L | Y | L | I | A | V | L | G | N | L | T | I | I | Y | I | 25 |
| 21 | 70 | G | I | D | I | L | I | S | T | S | S | M | P | K | M | L | 25 |
| 22 | 111 | G | M | E | S | T | V | L | L | A | M | A | F | D | R | Y | 25 |
| 23 | 148 | V | A | A | V | V | R | G | A | A | L | M | A | P | L | P | 25 |
| 24 | 162 | P | V | F | I | K | Q | L | P | F | C | R | S | N | I | L | 25 |

TABLE XXVIII-continued

HLA Class II Epitopes (sample 15-mer length)

| Pos | | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| 25 | 197 | N | V | V | Y | G | L | I | V | I | I | S | A | I | G | L | 25 |
| 26 | 211 | L | D | S | L | L | I | S | F | S | Y | L | I | L | K | | 25 |
| 27 | 218 | F | S | Y | L | L | I | L | K | T | V | L | G | L | T | R | 25 |
| 28 | 13 | Y | F | I | L | I | G | L | P | G | L | E | E | A | Q | F | 24 |
| 29 | 30 | A | F | P | L | C | S | L | Y | L | I | A | V | L | G | N | 24 |
| 30 | 39 | I | A | V | L | G | N | L | T | I | I | Y | I | V | R | T | 24 |
| 31 | 77 | T | S | S | M | P | K | M | L | A | I | F | W | F | N | S | 24 |
| 32 | 85 | A | I | F | W | F | N | S | T | T | I | Q | F | D | A | C | 24 |
| 33 | 137 | V | L | T | L | P | R | V | T | K | I | G | V | A | A | V | 24 |
| 34 | 151 | V | V | R | G | A | A | L | M | A | P | L | P | V | F | I | 24 |
| 35 | 161 | L | P | V | F | I | K | Q | L | P | F | C | R | S | N | I | 24 |
| 36 | 196 | V | N | V | V | Y | G | L | I | V | I | I | S | A | I | G | 24 |
| 37 | 202 | L | I | V | I | I | S | A | I | G | L | D | S | L | L | I | 24 |
| 38 | 208 | A | I | G | L | D | S | L | L | I | S | F | S | Y | L | L | 24 |
| 39 | 248 | A | V | F | I | F | Y | V | P | F | I | G | L | S | M | V | 24 |
| 40 | 251 | I | F | Y | V | P | F | I | G | L | S | M | V | H | R | F | 24 |
| 41 | 83 | M | L | A | I | F | W | F | N | S | T | T | I | Q | F | D | 23 |
| 42 | 101 | L | Q | I | F | A | I | H | S | L | S | G | M | E | S | T | 23 |
| 43 | 165 | I | K | Q | L | P | F | C | R | S | N | I | L | S | H | S | 23 |
| 44 | 203 | I | V | I | I | S | A | I | G | L | D | S | L | L | I | S | 23 |
| 45 | 221 | L | L | I | L | K | T | V | L | G | L | T | R | E | A | Q | 23 |
| 46 | 278 | A | N | I | Y | L | L | V | P | P | V | L | N | P | I | V | 23 |
| 47 | 27 | F | W | L | A | F | P | L | C | S | L | Y | L | I | A | V | 22 |
| 48 | 35 | S | L | Y | L | I | A | V | L | G | N | L | T | I | I | Y | 22 |
| 49 | 61 | M | Y | I | F | L | C | M | L | S | G | I | D | I | L | I | 22 |
| 50 | 65 | L | C | M | L | S | G | I | D | I | L | I | S | T | S | S | 22 |
| 51 | 80 | M | P | K | M | L | A | I | F | W | F | N | S | T | T | I | 22 |
| 52 | 145 | K | I | G | V | A | A | V | V | R | G | A | A | L | M | A | 22 |
| 53 | 146 | I | G | V | A | A | V | V | R | G | A | A | L | M | A | P | 22 |
| 54 | 154 | G | A | A | L | M | A | P | L | P | V | F | I | K | Q | L | 22 |
| 55 | 205 | I | I | S | A | I | G | L | D | S | L | L | I | S | F | S | 22 |
| 56 | 243 | V | S | H | V | C | A | V | F | I | F | Y | V | P | F | I | 22 |
| 57 | 270 | D | S | P | L | P | V | I | L | A | N | I | Y | L | L | V | 22 |
| 58 | 274 | P | V | I | L | A | N | I | Y | L | L | V | P | P | V | L | 22 |
| 59 | 281 | Y | L | L | V | P | P | V | L | N | P | I | V | Y | G | V | 22 |
| 60 | 34 | C | S | L | Y | L | I | A | V | L | G | N | L | T | I | I | 21 |
| 61 | 69 | S | G | I | D | I | L | I | S | T | S | S | M | P | K | M | 21 |
| 62 | 152 | V | R | G | A | A | L | M | A | P | L | P | V | F | I | K | 21 |
| 63 | 299 | E | I | R | Q | R | I | L | R | L | F | H | V | A | T | H | 21 |
| 64 | 100 | L | L | Q | I | F | A | I | H | S | L | S | G | M | E | S | 20 |
| 65 | 135 | A | T | V | L | T | L | P | R | V | T | K | I | G | V | A | 20 |
| 66 | 141 | P | R | V | T | K | I | G | V | A | A | V | V | R | G | A | 20 |
| 67 | 191 | C | D | D | I | R | V | N | V | V | Y | G | L | I | V | I | 20 |
| 68 | 199 | V | Y | G | L | I | V | I | I | S | A | I | G | L | D | S | 20 |
| 69 | 262 | V | H | R | F | S | K | R | R | D | S | P | L | P | V | I | 20 |
| 70 | 271 | S | P | L | P | V | I | L | A | N | I | Y | L | L | V | P | 20 |
| 71 | 28 | W | L | A | F | P | L | C | S | L | Y | L | I | A | V | L | 19 |
| 72 | 58 | H | E | P | M | Y | I | F | L | C | M | L | S | G | I | D | 19 |
| 73 | 59 | E | P | M | Y | I | F | L | C | M | L | S | G | I | D | I | 19 |
| 74 | 60 | P | M | Y | I | F | L | C | M | L | S | G | I | D | I | L | 19 |
| 75 | 98 | A | C | L | L | Q | I | F | A | I | H | S | L | S | G | M | 19 |
| 76 | 215 | L | I | S | F | S | Y | L | L | I | L | K | T | V | L | G | 19 |
| 77 | 219 | S | Y | L | L | I | L | K | T | V | L | G | L | T | R | E | 19 |
| 78 | 228 | L | G | L | T | R | E | A | Q | A | K | A | F | G | T | C | 19 |
| 79 | 232 | R | E | A | Q | A | K | A | F | G | T | C | V | S | H | V | 19 |
| 80 | 246 | V | C | A | V | F | I | F | Y | V | P | F | I | G | L | S | 19 |
| 81 | 297 | T | K | E | I | R | Q | R | I | L | R | L | F | H | V | A | 19 |
| 82 | 3 | D | P | N | G | N | E | S | S | A | T | Y | F | I | L | I | 18 |
| 83 | 14 | F | I | L | I | G | L | P | G | L | E | E | A | Q | F | W | 18 |
| 84 | 25 | A | Q | F | W | L | A | F | P | L | C | S | L | Y | L | I | 18 |
| 85 | 42 | L | G | N | L | T | I | I | Y | I | V | R | T | E | H | S | 18 |
| 86 | 46 | T | I | I | Y | I | V | R | T | E | H | S | L | H | E | P | 18 |
| 87 | 78 | S | S | M | P | K | M | L | A | I | F | W | F | N | S | T | 18 |
| 88 | 84 | L | A | I | F | W | F | N | S | T | T | I | Q | F | D | A | 18 |
| 89 | 89 | F | N | S | T | T | I | Q | F | D | A | C | L | L | Q | I | 18 |
| 90 | 93 | T | I | Q | F | D | A | C | L | L | Q | I | F | A | I | H | 18 |
| 91 | 115 | T | V | L | L | A | M | A | F | D | R | Y | V | A | I | C | 18 |
| 92 | 119 | A | M | A | F | D | R | Y | V | A | I | C | H | P | L | R | 18 |
| 93 | 127 | A | I | C | H | P | L | R | H | A | T | V | L | T | L | P | 18 |
| 94 | 129 | C | H | P | L | R | H | A | T | V | L | T | L | P | R | V | 18 |
| 95 | 147 | G | V | A | A | V | V | R | G | A | A | L | M | A | P | L | 18 |
| 96 | 149 | A | A | V | V | R | G | A | A | L | M | A | P | L | P | V | 18 |
| 97 | 216 | I | S | F | S | Y | L | L | I | L | K | T | V | L | G | L | 18 |
| 98 | 227 | V | L | G | L | T | R | E | A | Q | A | K | A | F | G | T | 18 |
| 99 | 249 | V | F | I | F | Y | V | P | F | I | G | L | S | M | V | H | 18 |

TABLE XXVIII-continued

HLA Class II Epitopes (sample 15-mer length)

| Pos | | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| 100 | 253 | Y | V | P | F | I | G | L | S | M | V | H | R | F | S | K | 18 |
| 101 | 284 | V | P | P | V | L | N | P | I | V | Y | G | V | K | T | K | 18 |
| 102 | 286 | P | V | L | N | P | I | V | Y | G | V | K | T | K | E | I | 18 |
| 103 | 303 | R | I | L | R | L | F | H | V | A | T | H | A | S | E | P | 18 |

HLA-DRB1*0301 (DR17) 15-mers

| | | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| 1 | 16 | L | I | G | L | P | G | L | E | E | A | Q | F | W | L | A | 26 |
| 2 | 206 | I | S | A | I | G | L | D | S | L | L | I | S | F | S | Y | 23 |
| 3 | 91 | S | T | T | I | Q | F | D | A | C | L | L | Q | I | F | A | 22 |
| 4 | 117 | L | L | A | M | A | F | D | R | Y | V | A | I | C | H | P | 22 |
| 5 | 38 | L | I | A | V | L | G | N | L | T | I | I | Y | I | V | R | 21 |
| 6 | 179 | S | Y | C | L | H | Q | D | V | M | K | L | A | C | D | D | 21 |
| 7 | 211 | L | D | S | L | L | I | S | F | S | Y | L | L | I | L | K | 21 |
| 8 | 219 | S | Y | L | L | I | L | K | T | V | L | G | L | T | R | E | 21 |
| 9 | 272 | P | L | P | V | I | L | A | N | I | Y | L | L | V | P | P | 21 |
| 10 | 26 | Q | F | W | L | A | F | P | L | C | S | L | Y | L | I | A | 20 |
| 11 | 114 | S | T | V | L | L | A | M | A | F | D | R | Y | V | A | I | 20 |
| 12 | 129 | C | H | P | L | R | H | A | T | V | L | T | L | P | R | V | 20 |
| 13 | 134 | H | A | T | V | L | T | L | P | R | V | T | K | I | G | V | 20 |
| 14 | 186 | V | M | K | L | A | C | D | D | I | R | V | N | V | V | Y | 20 |
| 15 | 200 | Y | G | L | I | V | I | S | A | I | G | L | D | S | L | 20 |
| 16 | 270 | D | S | P | L | P | V | I | L | A | N | I | Y | L | L | V | 20 |
| 17 | 297 | T | K | E | I | R | Q | R | I | L | R | L | F | H | V | A | 20 |
| 18 | 11 | A | T | Y | F | I | L | I | G | L | P | G | L | E | E | A | 19 |
| 19 | 54 | E | H | S | L | H | E | P | M | Y | I | F | L | C | M | L | 19 |
| 20 | 106 | I | H | S | L | S | G | M | E | S | T | V | L | L | A | M | 19 |
| 21 | 165 | I | K | Q | L | P | F | C | R | S | N | I | L | S | H | S | 19 |
| 22 | 191 | C | D | D | I | R | V | N | V | V | Y | G | L | I | V | I | 19 |
| 23 | 203 | I | V | I | I | S | A | I | G | L | D | S | L | L | I | S | 19 |
| 24 | 213 | S | L | L | I | S | F | S | Y | L | L | I | L | K | T | V | 19 |
| 25 | 224 | L | K | T | V | L | G | L | T | R | E | A | Q | A | K | A | 19 |
| 26 | 227 | V | L | G | L | T | R | E | A | Q | K | A | F | G | T | 19 |
| 27 | 248 | A | V | F | I | F | Y | V | P | F | I | G | L | S | M | V | 19 |
| 28 | 254 | V | P | F | I | G | L | S | M | V | H | R | F | S | K | R | 19 |
| 29 | 277 | L | A | N | I | Y | L | L | V | P | P | V | L | N | P | I | 19 |
| 30 | 36 | L | Y | L | I | A | V | L | G | N | L | T | I | I | Y | I | 18 |
| 31 | 93 | T | I | Q | F | D | A | C | L | L | Q | I | F | A | I | H | 18 |
| 32 | 98 | A | C | L | L | Q | I | F | A | I | H | S | L | S | G | M | 18 |
| 33 | 125 | Y | V | A | I | C | H | P | L | R | H | A | T | V | L | T | 18 |
| 34 | 158 | M | A | P | L | P | V | F | I | K | Q | L | P | F | C | R | 18 |
| 35 | 187 | M | K | L | A | C | D | D | I | R | V | N | V | V | Y | G | 18 |
| 36 | 217 | S | F | S | Y | L | L | I | L | K | T | V | L | G | L | T | 18 |
| 37 | 225 | K | T | V | L | G | L | T | R | E | A | Q | A | K | A | F | 18 |
| 38 | 281 | Y | L | L | V | P | P | V | L | N | P | I | V | Y | G | V | 18 |
| 39 | 288 | L | N | P | I | V | Y | G | V | K | T | K | E | I | R | Q | 18 |
| 40 | 18 | G | L | P | G | L | E | E | A | Q | F | W | L | A | F | P | 17 |
| 41 | 44 | N | L | T | I | I | Y | I | V | R | T | E | H | S | L | H | 17 |
| 42 | 145 | K | I | G | V | A | A | V | V | R | G | A | A | L | M | A | 17 |
| 43 | 159 | A | P | L | P | V | F | I | K | Q | L | P | F | C | R | S | 17 |
| 44 | 256 | F | I | G | L | S | M | V | H | R | F | S | K | R | R | D | 17 |
| 45 | 259 | L | S | M | V | H | R | F | S | K | R | R | D | S | P | L | 17 |
| 46 | 137 | V | L | T | L | P | R | V | T | K | I | G | V | A | A | V | 16 |
| 47 | 262 | V | H | R | F | S | K | R | R | D | S | P | L | P | V | I | 16 |
| 48 | 294 | G | V | K | T | K | E | I | R | Q | R | I | L | R | L | F | 16 |
| 49 | 46 | T | I | I | Y | I | V | R | T | E | H | S | L | H | E | P | 15 |
| 50 | 51 | V | R | T | E | H | S | L | H | E | P | M | Y | I | F | L | 15 |
| 51 | 172 | R | S | N | I | L | S | H | S | Y | C | L | H | Q | D | V | 15 |
| 52 | 189 | L | A | C | D | D | I | R | V | N | V | V | Y | G | L | I | 15 |
| 53 | 212 | D | S | L | L | I | S | F | S | Y | L | L | I | L | K | T | 15 |
| 54 | 218 | F | S | Y | L | L | I | L | K | T | V | L | G | L | T | R | 15 |
| 55 | 271 | S | P | L | P | V | I | L | A | N | I | Y | L | L | V | P | 15 |
| 56 | 279 | N | I | Y | L | L | V | P | P | V | L | N | P | I | V | 15 |
| 57 | 12 | T | Y | F | I | L | I | G | L | P | G | L | E | E | A | Q | 14 |
| 58 | 35 | S | L | Y | L | I | A | V | L | G | N | L | T | I | I | Y | 14 |
| 59 | 64 | F | L | C | M | L | S | G | I | D | I | L | I | S | T | S | 14 |
| 60 | 140 | L | P | R | V | T | K | I | G | V | A | A | V | V | R | G | 14 |
| 61 | 273 | L | P | V | I | L | A | N | I | Y | L | L | V | P | P | V | 14 |
| 62 | 301 | R | Q | R | I | L | R | L | F | H | V | A | T | H | A | S | 14 |
| 63 | 13 | Y | F | I | L | I | G | L | P | G | L | E | E | A | Q | F | 13 |
| 64 | 47 | I | I | Y | I | V | R | T | E | H | S | L | H | E | P | M | 13 |
| 65 | 71 | I | D | I | L | I | S | T | S | S | M | P | K | M | L | A | 13 |
| 66 | 80 | M | P | K | M | L | A | I | F | W | F | N | S | T | T | I | 13 |
| 67 | 109 | L | S | G | M | E | S | T | V | L | L | A | M | A | F | D | 13 |
| 68 | 113 | E | S | T | V | L | L | A | M | A | F | D | R | Y | V | A | 13 |
| 69 | 135 | A | T | V | L | T | L | P | R | V | T | K | I | G | V | A | 13 |

TABLE XXVIII-continued

HLA Class II Epitopes (sample 15-mer length)

| | Pos | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| 70 | 195 | R | V | N | V | V | Y | G | L | I | V | I | I | S | A | I | 13 |
| 71 | 202 | L | I | V | I | I | S | A | I | G | L | D | S | L | L | I | 13 |
| 72 | 220 | Y | L | L | I | L | K | T | V | L | G | L | T | R | E | A | 13 |
| 73 | 221 | L | L | I | L | K | T | V | L | G | L | T | R | E | A | Q | 13 |
| 74 | 264 | R | F | S | K | R | R | D | S | P | L | P | V | I | L | A | 13 |
| 75 | 280 | I | Y | L | L | V | P | P | V | L | N | P | I | V | Y | G | 13 |
| 76 | 302 | Q | R | I | L | R | L | F | H | V | A | T | H | A | S | E | 13 |

HLA-DRB1*0401 (DR4Dw4) 15-mers

| | Pos | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| 1 | 36 | L | Y | L | I | A | V | L | G | N | L | T | I | I | Y | I | 26 |
| 2 | 45 | L | T | I | I | Y | I | V | R | T | E | H | S | L | H | E | 26 |
| 3 | 68 | L | S | G | I | D | I | L | I | S | T | S | S | M | P | K | 26 |
| 4 | 83 | M | L | A | I | F | W | F | N | S | T | T | I | Q | F | D | 26 |
| 5 | 134 | H | A | T | V | L | T | L | P | R | V | T | K | I | G | V | 26 |
| 6 | 145 | K | I | G | V | A | A | V | V | R | G | A | A | L | M | A | 26 |
| 7 | 224 | L | K | T | V | L | G | L | T | R | E | A | Q | A | K | A | 26 |
| 8 | 227 | V | L | G | L | T | R | E | A | Q | A | K | A | F | G | T | 26 |
| 9 | 256 | F | I | G | L | S | M | V | H | R | F | S | K | R | R | D | 26 |
| 10 | 281 | Y | L | L | V | P | P | V | L | N | P | I | V | Y | G | V | 26 |
| 11 | 289 | N | P | I | V | Y | G | V | K | T | K | E | I | R | Q | R | 26 |
| 12 | 301 | R | Q | R | I | L | R | L | F | H | V | A | T | H | A | S | 26 |
| 13 | 11 | A | T | Y | F | I | L | I | G | L | P | G | L | E | E | A | 22 |
| 14 | 24 | E | A | Q | F | W | L | A | F | P | L | C | S | L | Y | L | 22 |
| 15 | 25 | A | Q | F | W | L | A | F | P | L | C | S | L | Y | L | I | 22 |
| 16 | 34 | C | S | L | Y | L | I | A | V | L | G | N | L | T | I | I | 22 |
| 17 | 84 | L | A | I | F | W | F | N | S | T | T | I | Q | F | D | A | 22 |
| 18 | 122 | F | D | R | Y | V | A | I | C | H | P | L | R | H | A | T | 22 |
| 19 | 197 | N | V | V | Y | G | L | I | V | I | I | S | A | I | G | L | 22 |
| 20 | 215 | L | I | S | F | S | Y | L | L | I | L | K | T | V | L | G | 22 |
| 21 | 217 | S | F | S | Y | L | L | I | L | K | T | V | L | G | L | T | 22 |
| 22 | 250 | F | I | F | Y | V | P | F | I | G | L | S | M | V | H | R | 22 |
| 23 | 278 | A | N | I | Y | L | L | V | P | P | V | L | N | P | I | V | 22 |
| 24 | 19 | L | P | G | L | E | E | A | Q | F | W | L | A | F | P | L | 20 |
| 25 | 30 | A | F | P | L | C | S | L | Y | L | I | A | V | L | G | N | 20 |
| 26 | 33 | L | C | S | L | Y | L | I | A | V | L | G | N | L | T | I | 20 |
| 27 | 35 | S | L | Y | L | I | A | V | L | G | N | L | T | I | I | Y | 20 |
| 28 | 39 | I | A | V | L | G | N | L | T | I | I | Y | I | V | R | T | 20 |
| 29 | 42 | L | G | N | L | T | I | I | Y | I | V | R | T | E | H | S | 20 |
| 30 | 44 | N | L | T | I | I | Y | I | V | R | T | E | H | S | L | H | 20 |
| 31 | 48 | I | Y | I | V | R | T | E | H | S | L | H | E | P | M | Y | 20 |
| 32 | 58 | H | E | P | M | Y | I | F | L | C | M | L | S | G | I | D | 20 |
| 33 | 62 | Y | I | F | L | C | M | L | S | G | I | D | I | L | I | S | 20 |
| 34 | 65 | L | C | M | L | S | G | I | D | I | L | I | S | T | S | S | 20 |
| 35 | 71 | I | D | I | L | I | S | T | S | S | M | P | K | M | L | A | 20 |
| 36 | 80 | M | P | K | M | L | A | I | F | W | F | N | S | T | T | I | 20 |
| 37 | 81 | P | K | M | L | A | I | F | W | F | N | S | T | T | I | Q | 20 |
| 38 | 91 | S | T | T | I | Q | F | D | A | C | L | L | Q | I | F | A | 20 |
| 39 | 97 | D | A | C | L | L | Q | I | F | A | I | H | S | L | S | G | 20 |
| 40 | 98 | A | C | L | L | Q | I | F | A | I | H | S | L | S | G | M | 20 |
| 41 | 100 | L | L | Q | I | F | A | I | H | S | L | S | G | M | E | S | 20 |
| 42 | 103 | I | F | A | I | H | S | L | S | G | M | E | S | T | V | L | 20 |
| 43 | 106 | I | H | S | L | S | G | M | E | S | T | V | L | L | A | M | 20 |
| 44 | 115 | T | V | L | L | A | M | A | F | D | R | Y | V | A | I | C | 20 |
| 45 | 117 | L | L | A | M | A | F | D | R | Y | V | A | I | C | H | P | 20 |
| 46 | 125 | Y | V | A | I | C | H | P | L | R | H | A | T | V | L | T | 20 |
| 47 | 129 | C | H | P | L | R | H | A | T | V | L | T | L | P | R | V | 20 |
| 48 | 137 | V | L | T | L | P | R | V | T | K | I | G | V | A | A | V | 20 |
| 49 | 140 | L | P | R | V | T | K | I | G | V | A | A | V | R | G | 20 |
| 50 | 155 | A | A | L | M | A | P | L | P | V | F | I | K | Q | L | P | 20 |
| 51 | 162 | P | V | F | I | K | Q | L | P | F | C | R | S | N | I | L | 20 |
| 52 | 165 | I | K | Q | L | P | F | C | R | S | N | I | L | S | H | S | 20 |
| 53 | 179 | S | Y | C | L | H | Q | D | V | M | K | L | A | C | D | D | 20 |
| 54 | 183 | H | Q | D | V | M | K | L | A | C | D | D | I | R | V | N | 20 |
| 55 | 186 | V | M | K | L | A | C | D | D | I | R | V | N | V | V | Y | 20 |
| 56 | 193 | D | I | R | V | N | V | V | Y | G | L | I | V | I | I | S | 20 |
| 57 | 196 | V | N | V | V | Y | G | L | I | V | I | I | S | A | I | G | 20 |
| 58 | 199 | V | Y | G | L | I | V | I | I | S | A | I | G | L | D | S | 20 |
| 59 | 200 | Y | G | L | I | V | I | I | S | A | I | G | L | D | S | L | 20 |
| 60 | 202 | L | I | V | I | I | S | A | I | G | L | D | S | L | L | I | 20 |
| 61 | 203 | I | V | I | I | S | A | I | G | L | D | S | L | L | I | S | 20 |
| 62 | 206 | I | S | A | I | G | L | D | S | L | L | I | S | F | S | Y | 20 |
| 63 | 208 | A | I | G | L | D | S | L | L | I | S | F | S | Y | L | L | 20 |
| 64 | 211 | L | D | S | L | L | I | S | F | S | Y | L | L | I | L | K | 20 |
| 65 | 212 | D | S | L | L | I | S | F | S | Y | L | L | I | L | K | T | 20 |
| 66 | 218 | F | S | Y | L | L | I | L | K | T | V | L | G | L | T | R | 20 |

TABLE XXVIII-continued

HLA Class II Epitopes (sample 15-mer length)

| Pos | | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| 67 | 240 | G | T | C | V | S | H | V | C | A | V | F | I | F | Y | V | 20 |
| 68 | 243 | V | S | H | V | C | A | V | F | I | F | Y | V | P | F | I | 20 |
| 69 | 246 | V | C | A | V | F | I | F | Y | V | P | F | I | G | L | S | 20 |
| 70 | 248 | A | V | F | I | F | Y | V | P | F | I | G | L | S | M | V | 20 |
| 71 | 251 | I | F | Y | V | P | F | I | G | L | S | M | V | H | R | F | 20 |
| 72 | 272 | P | L | P | V | I | L | A | N | I | Y | L | L | V | P | P | 20 |
| 73 | 277 | L | A | N | I | Y | L | L | V | P | P | V | L | N | P | I | 20 |
| 74 | 285 | P | P | V | L | N | P | I | V | Y | G | V | K | T | K | E | 20 |
| 75 | 18 | G | L | P | G | L | E | E | A | Q | F | W | L | A | F | P | 18 |
| 76 | 27 | F | W | L | A | F | P | L | C | S | L | Y | L | I | A | V | 18 |
| 77 | 69 | S | G | I | D | I | L | I | S | T | S | S | M | P | K | M | 18 |
| 78 | 94 | I | Q | F | D | A | C | L | L | Q | I | F | A | I | H | S | 18 |
| 79 | 99 | C | L | L | Q | I | F | A | I | H | S | L | S | G | M | E | 18 |
| 80 | 107 | H | S | L | S | G | M | E | S | T | V | L | L | A | M | A | 18 |
| 81 | 116 | V | L | L | A | M | A | F | D | R | Y | V | A | I | C | H | 18 |
| 82 | 126 | V | A | I | C | H | P | L | R | H | A | T | V | L | T | L | 18 |
| 83 | 164 | F | I | K | Q | L | P | F | C | R | S | N | I | L | S | H | 18 |
| 84 | 176 | L | S | H | S | Y | C | L | H | Q | D | V | M | K | L | A | 18 |
| 85 | 187 | M | K | L | A | C | D | D | I | R | V | N | V | V | Y | G | 18 |
| 86 | 205 | I | I | S | A | I | G | L | D | S | L | L | I | S | F | S | 18 |
| 87 | 233 | E | A | Q | A | K | A | F | G | T | C | V | S | H | V | C | 18 |
| 88 | 237 | K | A | F | G | T | C | V | S | H | V | C | A | V | F | I | 18 |
| 89 | 271 | S | P | L | P | V | I | L | A | N | I | Y | L | L | V | P | 18 |
| 90 | 293 | Y | G | V | K | T | K | E | I | R | Q | R | I | L | R | L | 18 |
| 91 | 294 | G | V | K | T | K | E | I | R | Q | R | I | L | R | L | F | 18 |
| 92 | 10 | S | A | T | Y | F | I | L | I | G | L | P | G | L | E | E | 16 |
| 93 | 28 | W | L | A | F | P | L | C | S | L | Y | L | I | A | V | L | 16 |
| 94 | 59 | E | P | M | Y | I | F | L | C | M | L | S | G | I | D | I | 16 |
| 95 | 61 | M | Y | I | F | L | C | M | L | S | G | I | D | I | L | I | 16 |
| 96 | 85 | A | I | F | W | F | N | S | T | T | I | Q | F | D | A | C | 16 |
| 97 | 101 | L | Q | I | F | A | I | H | S | L | S | G | M | E | S | T | 16 |
| 98 | 177 | S | H | S | Y | C | L | H | Q | D | V | M | K | L | A | C | 16 |
| 99 | 236 | A | K | A | F | G | T | C | V | S | H | V | C | A | V | F | 16 |
| 100 | 249 | V | F | I | F | Y | V | P | F | I | G | L | S | M | V | H | 16 |
| 101 | 253 | Y | V | P | F | I | G | L | S | M | V | H | R | F | S | K | 16 |
| 102 | 13 | Y | F | I | L | I | G | L | P | G | L | E | E | A | Q | F | 14 |
| 103 | 14 | F | I | L | I | G | L | P | G | L | E | E | A | Q | F | W | 14 |
| 104 | 16 | L | I | G | L | P | G | L | E | E | A | Q | F | W | L | A | 14 |
| 105 | 38 | L | I | A | V | L | G | N | L | T | I | I | Y | I | V | R | 14 |
| 106 | 47 | I | I | Y | I | V | R | T | E | H | S | L | H | E | P | M | 14 |
| 107 | 54 | E | H | S | L | H | E | P | M | Y | I | F | L | C | M | L | 14 |
| 108 | 60 | P | M | Y | I | F | L | C | M | L | S | G | I | D | I | L | 14 |
| 109 | 64 | F | L | C | M | L | S | G | I | D | I | L | I | S | T | S | 14 |
| 110 | 70 | G | I | D | I | L | I | S | T | S | S | M | P | K | M | L | 14 |
| 111 | 72 | D | I | L | I | S | T | S | S | M | P | K | M | L | A | I | 14 |
| 112 | 109 | L | S | G | M | E | S | T | V | L | L | A | M | A | F | D | 14 |
| 113 | 113 | E | S | T | V | L | L | A | M | A | F | D | R | Y | V | A | 14 |
| 114 | 135 | A | T | V | L | T | L | P | R | V | T | K | I | G | V | A | 14 |
| 115 | 143 | V | T | K | I | G | V | A | A | V | V | R | G | A | A | L | 14 |
| 116 | 148 | V | A | A | V | V | R | G | A | A | L | M | A | P | L | P | 14 |
| 117 | 149 | A | A | V | V | R | G | A | A | L | M | A | P | L | P | V | 14 |
| 118 | 154 | G | A | A | L | M | A | P | L | P | V | F | I | K | Q | L | 14 |
| 119 | 158 | M | A | P | L | P | V | F | I | K | Q | L | P | F | C | R | 14 |
| 120 | 173 | S | N | I | L | S | H | S | Y | C | L | H | Q | D | V | M | 14 |
| 121 | 184 | Q | D | V | M | K | L | A | C | D | D | I | R | V | N | V | 14 |
| 122 | 191 | C | D | D | I | R | V | N | V | V | Y | G | L | I | V | I | 14 |
| 123 | 195 | R | V | N | V | V | Y | G | L | I | V | I | I | S | A | I | 14 |
| 124 | 213 | S | L | L | I | S | F | S | Y | L | L | I | L | K | T | V | 14 |
| 125 | 220 | Y | L | L | I | L | K | T | V | L | G | L | T | R | E | A | 14 |
| 126 | 221 | L | L | I | L | K | T | V | L | G | L | T | R | E | A | Q | 14 |
| 127 | 225 | K | T | V | L | G | L | T | R | E | A | Q | A | K | A | F | 14 |
| 128 | 259 | L | S | M | V | H | R | F | S | K | R | R | D | S | P | L | 14 |
| 129 | 270 | D | S | P | L | P | V | I | L | A | N | I | Y | L | L | V | 14 |
| 130 | 273 | L | P | V | I | L | A | N | I | Y | L | L | V | P | P | V | 14 |
| 131 | 274 | P | V | I | L | A | N | I | Y | L | L | V | P | P | V | L | 14 |
| 132 | 280 | I | Y | L | L | V | P | P | V | L | N | P | I | V | Y | G | 14 |
| 133 | 284 | V | P | P | V | L | N | P | I | V | Y | G | V | K | T | K | 14 |
| 134 | 302 | Q | R | I | L | R | L | F | H | V | A | T | H | A | S | E | 14 |

HLA-DRB1*1101 15-mers

| | | | | | | | | | | | | | | | | | |
|---|---|---|---|---|---|---|---|---|---|---|---|---|---|---|---|---|---|
| 1 | 145 | K | I | G | V | A | A | V | V | R | G | A | A | L | M | A | 28 |
| 2 | 122 | F | D | R | Y | V | A | I | C | H | P | L | R | H | A | T | 25 |
| 3 | 217 | S | F | S | Y | L | L | I | L | K | T | V | L | G | L | T | 25 |
| 4 | 197 | N | V | V | Y | G | L | I | V | I | I | S | A | I | G | L | 24 |
| 5 | 10 | S | A | T | Y | F | I | L | I | G | L | P | G | L | E | E | 23 |

TABLE XXVIII-continued

HLA Class II Epitopes (sample 15-mer length)

| Pos | | 1 | 2 | 3 | 4 | 5 | 6 | 7 | 8 | 9 | 0 | 1 | 2 | 3 | 4 | 5 | score |
|---|---|---|---|---|---|---|---|---|---|---|---|---|---|---|---|---|---|
| 6 | 255 | P | F | I | G | L | S | M | V | H | R | F | S | K | R | R | 23 |
| 7 | 44 | N | L | T | I | I | Y | I | V | R | T | E | H | S | L | H | 22 |
| 8 | 59 | E | P | M | Y | I | F | L | C | M | L | S | G | I | D | I | 22 |
| 9 | 158 | M | A | P | L | P | V | F | I | K | Q | L | P | F | C | R | 22 |
| 10 | 237 | K | A | F | G | T | C | V | S | H | V | C | A | V | F | I | 22 |
| 11 | 74 | L | I | S | T | S | S | M | P | K | M | L | A | I | F | W | 21 |
| 12 | 134 | H | A | T | V | L | T | L | P | R | V | T | K | I | G | V | 20 |
| 13 | 137 | V | L | T | L | P | R | V | T | K | I | G | V | A | A | V | 20 |
| 14 | 162 | P | V | F | I | K | Q | L | P | F | C | R | S | N | I | L | 20 |
| 15 | 199 | V | Y | G | L | I | V | I | I | S | A | I | G | L | D | S | 20 |
| 16 | 224 | L | K | T | V | L | G | L | T | R | E | A | Q | A | K | A | 20 |
| 17 | 256 | F | I | G | L | S | M | V | H | R | F | S | K | R | R | D | 20 |
| 18 | 290 | P | I | V | Y | G | V | K | T | K | E | I | R | Q | R | I | 20 |
| 19 | 301 | R | Q | R | I | L | R | L | F | H | V | A | T | H | A | S | 20 |
| 20 | 65 | L | C | M | L | S | G | I | D | I | L | I | S | T | S | S | 19 |
| 21 | 100 | L | L | Q | I | F | A | I | H | S | L | S | G | M | E | S | 19 |
| 22 | 196 | V | N | V | V | Y | G | L | I | V | I | I | S | A | I | G | 19 |
| 23 | 218 | F | S | Y | L | L | I | L | K | T | V | L | G | L | T | R | 19 |
| 24 | 247 | C | A | V | F | I | F | Y | V | P | F | I | G | L | S | M | 19 |
| 25 | 274 | P | V | I | L | A | N | I | Y | L | L | V | P | P | V | L | 19 |
| 26 | 45 | L | T | I | I | Y | I | V | R | T | E | H | S | L | H | E | 18 |
| 27 | 68 | L | S | G | I | D | I | L | I | S | T | S | S | M | P | K | 18 |
| 28 | 80 | M | P | K | M | L | A | I | F | W | F | N | S | T | T | I | 18 |
| 29 | 97 | D | A | C | L | L | Q | I | F | A | I | H | S | L | S | G | 18 |
| 30 | 103 | I | F | A | I | H | S | L | S | G | M | E | S | T | V | L | 18 |
| 31 | 208 | A | I | G | L | D | S | L | L | I | S | F | S | Y | L | L | 18 |
| 32 | 249 | V | F | I | F | Y | V | P | F | I | G | L | S | M | V | H | 18 |
| 33 | 61 | M | Y | I | F | L | C | M | L | S | G | I | D | I | L | I | 17 |
| 34 | 215 | L | I | S | F | S | Y | L | L | I | L | K | T | V | L | G | 17 |
| 35 | 259 | L | S | M | V | H | R | F | S | K | R | R | D | S | P | L | 17 |
| 36 | 278 | A | N | I | Y | L | L | V | P | P | V | L | N | P | I | V | 17 |
| 37 | 288 | L | N | P | I | V | Y | G | V | K | T | K | E | I | R | Q | 17 |
| 38 | 11 | A | T | Y | F | I | L | I | G | L | P | G | L | E | E | A | 16 |
| 39 | 24 | E | A | Q | F | W | L | A | F | P | L | C | S | L | Y | L | 16 |
| 40 | 42 | L | G | N | L | T | I | I | Y | I | V | R | T | E | H | S | 16 |
| 41 | 253 | Y | V | P | F | I | G | L | S | M | V | H | R | F | S | K | 16 |
| 42 | 47 | I | I | Y | I | V | R | T | E | H | S | L | H | E | P | M | 15 |
| 43 | 99 | C | L | L | Q | I | F | A | I | H | S | L | S | G | M | E | 15 |
| 44 | 116 | V | L | L | A | M | A | F | D | R | Y | V | A | I | C | H | 15 |
| 45 | 143 | V | T | K | I | G | V | A | A | V | V | R | G | A | A | L | 15 |
| 46 | 179 | S | Y | C | L | H | Q | D | V | M | K | L | A | C | D | D | 15 |
| 47 | 227 | V | L | G | L | T | R | E | A | Q | A | K | A | F | G | T | 15 |
| 48 | 260 | S | M | V | H | R | F | S | K | R | R | D | S | P | L | P | 15 |
| 49 | 261 | M | V | H | R | F | S | K | R | R | D | S | P | L | P | V | 15 |
| 50 | 277 | L | A | N | I | Y | L | L | V | P | P | V | L | N | P | I | 15 |
| 51 | 285 | P | P | V | L | N | P | I | V | Y | G | V | K | T | K | E | 15 |
| 52 | 114 | S | T | V | L | L | A | M | A | F | D | R | Y | V | A | I | 14 |
| 53 | 125 | Y | V | A | I | C | H | P | L | R | H | A | T | V | L | T | 14 |
| 54 | 126 | V | A | I | C | H | P | L | R | H | A | T | V | L | T | L | 14 |
| 55 | 140 | L | P | R | V | T | K | I | G | V | A | A | V | V | R | G | 14 |
| 56 | 170 | F | C | R | S | N | I | L | S | H | S | Y | C | L | H | Q | 14 |
| 57 | 180 | Y | C | L | H | Q | D | V | M | K | L | A | C | D | D | I | 14 |
| 58 | 193 | D | I | R | V | N | V | V | Y | G | L | I | V | I | I | S | 14 |
| 59 | 229 | G | L | T | R | E | A | Q | A | K | A | F | G | T | C | V | 14 |
| 60 | 270 | D | S | P | L | P | V | I | L | A | N | I | Y | L | L | V | 14 |
| 61 | 298 | K | E | I | R | Q | R | I | L | R | L | F | H | V | A | T | 14 |

TABLE XXIX

Nucleotide sequence in the 5' region close to 101P3A11 gene.

```
  1 TGCGCTCCAC CAAGCCTGGC TAACTTTTGC ATTTTTAATA GAGGCAGGGT TTCACCATGT

61 TGGCCTGGCT GGTCTCGAAC CCCTGACCTT GCGATCTGCC CACCTCGGCC TCCCAAAGTG

121 CTGGGATTAC AGGCGTGAGC CACTGTACCT GGCGGGGCTT ATTGTTTTTT AAAAAGATTT

181 CCAAAACCTT GCCCTGGCAA TTCTGATTTT CTGGGCCTGG AGCAGGACCT GGAGGGATGG

241 TGTTGTCAAT TACTTTAGAT GTTTCTATCA GGAAAGTTTG AGAAATGGTA TTCAGGCCTA

301 AACACAAACC TCTCTTGAAA TCTCATCCCA GACTGAGCCC CTGCTCCCTA TCTTAAATTA
```

TABLE XXIX-continued

Nucleotide sequence in the 5' region close to 101P3A11 gene.

```
 361 GATTATAGTA GGTCTTAAAG TCAGCTGTAG ACTGAGCCTC TAAATCTGAA CCCAGACCCA
 421 CCCTAACCCC AGGATACATC AGAAGAGCTG GTCAATGTGG ACCATTCTGA GCAATCCTGC
 481 AAGTCTACTC TGATGGGAAA AGGCTAAGAG CAGTGCCCTG GGCAGCAACA TCAGCTCTGA
 541 AGATGCAGGA CTGTGTTACA TGTTTTATGA GTGGGTCTTC ACACACTGAG ATTCATGGGA
 601 CAGTAATAGA ATCTGCTTGT GCAGCACTGG GGCCTTGGAG GTCAGGGTA AGGCTCAAGA
 661 TGTCCAGGAA GTTGTATATA AGGAGAATCA GACCAGAGAG AGACTAGGGT TCAGAATTAC
 721 CAGGATGACT TAGTCCTGTT TGTTACTGTC ACCACTCCAA TGCCTTTTCC TCATTAGTCC
 781 TTTCTCTCCT CTGAGCCACA ACTAAATGAT GTTTCTACTT TTCCCTTTCT ACTTTCCTAG
 841 ACCCTGGATT TTGTATGCAG AAGCCCCAGC TCTTGGTCCC TATCATAGCC ACTTCAAATG
 901 GAAATCTGGT CCACGCAGCA TACTTCCTTT TGGTGGGTAT CCCTGGCCTG GGGCCTACCA
 961 TACACTTTTG GCTGGCTTTC CCACTGTGTT TTATGTATGC CTTGGCCACC CTGGGTAACC
1021 TGACCATTGT CCTCATCATT CGTGTGGAGA GGCGACTGCA TGAGCCCATG TACCTCTTCC
1081 TGGCCATGCT TTCCACTATT GACCTAGTCC TCTCCTCTAT CACCATGCCC AAGATGGCCA
1141 GTCTTTTCCT GATGGGCATC CAGGAGATCG AGTTCAACAT TTGCCTGGCC CAGATGTTCC
1201 TTATCCATGC TCTGTCAGCC GTGGAGTCAG CTGTCCTGCT GGCCATGGCT TTTGACCGCT
1261 TTGTGGCCAT TTGCCACCCA TTGCGCCATG CTTCTGTGCT GACAGGGTGT ACTGTGGCCA
1321 AGATTGGACT ATCTGCCCTG ACCAGGGGGT TTGTATTCTT CTTCCCACTG CCCTTCATCC
1381 TCAAGTGGTT GTCCTACTGC CAAACACATA CTGTCACACA CTCCTTCTGT CTGCACCAAG
1441 ATATTATGAA GCTGTCCTGT ACTGACACCA GGGTCAATGT GGTTTATGGA CTCTTCATCA
1501 TCCTCTCAGT CATGGGTGTG GACTCTCTCT TCATTGGCTT CTCATATATC CTCATCCTGT
1561 GGGCTGTTTT GGAGCTGTCC TCTCGGAGGG CAGCACTCAA GGCTTTCAAC ACCTGCATCT
1621 CCCACCTCTG TGCTGTTCTG GTCTTCTATG TACCCCTCAT TGGGCTCTCG GTGGTGCATA
1681 GGCTGGGTGG TCCCACCTCC CTCCTCCATG TGGTTATGGC TAATACCTAC TTGCTGCTAC
1741 CACCTGTAGT CAACCCCCTT GTCTATGGAG CCAAGACCAA AGAGATCTGT TCAAGGGTCC
1801 TCTGTATGTT CTCACAAGGT GGCAAGTGAG ACACCTTAGT GTCTCGCTTC TACTACTACT
1861 ACAGAAGATG GGAATATTAG GATCCTATTG AATGCCTTGG TGATTAAAGT ATCAAACCTA
1921 TTGTGCTGTC TTCTTCCAGC AATTTAAGTA GATCATGTAT TCTGTCTCCA GGAATGTGTC
1981 AGTACTGAAC TTATGACCCT GTCTGGACAT CCTGGAGAAT GACTGCACTA GTCCCTCTGC
2041 TATGGTGGTC TTGCCTTCTC CTTCTCTCTC AGCTAGAAAA TACATCTAGT TTTGACATGG
2101 GGAGGCTGTA AAGATCACAC CTCATGGTTC ATTCCAGTTT TGAAGTATGA TTTTAATGTT
2161 CTTGCCCCCA TGTGCCCATG TTGGTGAATT TGCATGGACT ATAAACGTTA TTGCAAATAC
2221 CCTAAAGTGG TTACCCAGCC ATAATCAGGG GTTAATGAAG GTATTTGGGG AATAGTAACT
2281 GGAGAGACAG CAACAAGACA AGAGGCAGCT CACATGCAAT GTTGAAGTTT CTGTATGCAA
2341 GAGGGTGTGT TGGCAGATTT GTGAAATCTG CCCATTTGCA TCTGTATGGC TCTATATGAC
2401 TATTTGTCCA TAAGGGTGCC ATGTATTCTG GTTGTGGGTG TGAATGTGTG GGTGTGTTTA
2461 TGTGGACACT TGCTTTTCAG TGTGCGTATA TGTGAGAGAG AGGGTGCACA CATGGAATAC
2521 GTACTGGTTG TGTCCTGGTG AGTGTGGTAG CTATGTCCTG GCACATGTAT GTTTCATGAG
2581 ACGTGTCTCT GATTGCGCAT TTGTATTTCT GTGGTATCTG TTAGTTGGTA TATGATATGT
```

TABLE XXIX-continued

Nucleotide sequence in the 5' region close to 101P3A11 gene.

```
2641 GTCTACGTGA GAATGCTGGT GTCTGTATCT GCATGGTGGG CAGTACCTTT ATGTGTATCT
2701 GGTAAGAATG CTGCCTCTAC CTTTTCTTCC TATTTGTACT ATGTGAATGT GGTGCATGAA
2761 TGTGTGGAAT GTGTGGAATG TGTAGTATTG GGATGCCTGT ATCTTTCAGC GTGTTTGGGT
2821 GTATGTCCAC TGTGCATAAT ATTTGAGATG TAAAACCATT TTGTGCGGTA TATGTGTTAT
2881 TAGTTGTAAG TCGGTGAAAT GTACATCTGA ATTCTGTGTG CATATTGTTG GTACTGATGC
2941 TATTTTCGTG CATATGTCTA GTGTATATGT TTTAAGGCAA ACTTTCTTTG TGTGTTGGGT
3001 GTGTATGTGA CACGAATGGG GACAGCATCT GTATTTCTGA GCATGGATTG ATGTGTGGTG
3061 TCTGTATGTA TCTTGGAATG GAGGAGGGAG ATTGAAGAAG TCTGGCTGTG AGCAGCAGAA
3121 ATAATTTCCA AAGTTGAGTG ACATGACTCT AAGATGCCCA GTTTCTCGGC CTGGGGTCAG
3181 CCTGGGTGAT AGCTCAGTCT GTCAGAATGA AGGAAACAC GGTGCTTCCT TGCTCCACCT
3241 TTTCACAGGC CAGACCACAC CTTCTTCATC CTGAACACAA GGATTTCAAG GGCTTTTGTT
3301 ACCTCTTCCT ACGTTTCCTG CCTCTGCTAT CCGAGGCACT GGCCTCCCTA AACCCTGCCC
3361 TCCTGCCTCA ATAGCAAGTC ATGGTATCCT CACCTCTCCC TTCCCTTTTT GGCTTATCT<u>G</u>
3421 <u>CCAAACATGT ATAAAAGTCC TTGGTTCCCC ATCTCTACTA AAAATACAAC</u> AATTAGCCGG
3481 GTGTGATGGC GCGTGCCTGT AGTCCCAGCT AGTTGGGAGG CTGAGGCAGG AGAAACGCTT
3541 GAGCCCGCAA GGTGGAGGTT GCAGTGAGCC GAGATCATGC CACTGCACTC CAGCCTGGTG
3601 ACAGAGCAAG ACTCTGTGTC AAAAAAAAAA AAAAAAAAAA AGCCTTGGTT GTAGGGAGTT
3661 TCTCCTAATC CCTCTGGGAA AGCAAGGGTG GAGGGGAAGC CAGTCAATCT CCCTTCTGTT
3721 GCCGCATGGA AACTCCCTTA AGGCAGGAAG CTGAAAAAAC TGTAGCATTC ACCTCATTAT
3781 TCACCTTGTC TCATGTCTCA CTGTCCTTCC ACATGTCTCA TTGTTACTCC ATATTGGATG
3841 GAAGTAGAAG TCCCTTTGGT ATTTTTTAAA GTCTTTGCCA TGTCTAAGTT AATGAGGTTA
3901 ATGGAGGCAG CAGAGATGGC TCCAGGGTTC TGATAGCAAG TGTCAGGCTG CGTGCTCTGT
3961 AGGCACCAGA AACTGTTGTC ACCAGTAATT TTGATGTGGT CTGAGTTAGA ATGGTCTGAT
4021 TTGCCATGAT CTATTTAACA TAGCTTGATT TAGCGTGTCC TGTGTTCTGA ATTTAAAACT
4081 CACAGTTGTG AA<u>ACTGATCA GTAAAAAATA AGGGGAGACC AACTAAAAAC CATGTTGTTC
4141 TA</u>TTTATAGA TGTAGTTTTT ACTTATTTCA AAATACGAGG TATTTAGTTT TACATTCAAA
4201 TTGTTCTCTA ACTCTCTAAA ATGTTCTCTG ACTATTTTTG CCCTTAAGGG AGAAACCAGA
4261 TGTCATTGGT CTTACGTGGC TGGTGTTGGG GGTGGGGAGG GTTAAAGAAA CCACGTTCTC
4321 TGTCCTCAGC CAGAAGTTCA GTAATCCAAG GCCAGAGAGT GGACGGCAGA GGCACTGTCC
4381 CTGGGGACCT TGGTTATAAG TTATCCAGAC ACAGGGACCA GAGCCTGGGA GACAAAAAAA
4441 GATGTAGCCC TAGGGCTTTG GGAAAAGGAG GATGGACCCA GTGAATTCCA CGCTTAGCAA
4501 GGACCTAAAC AGTGTCCCCC AAATGAGAGA AGGGAGGACA GAAAGAACAC TTCAGGATGG
4561 AAATGGGCTG ACACTTAACC GTGGAGTGTC TCTGCAAACT TCCTTTGCCA TTCTCCTGTT
4621 TGAGTTTGAT AAACCTGAGA AGAGACTTGG ATAAAGACCG TCACGAAGAC TACACTAATG
4681 AGTTTCTTCT AGCTTTTTTC TACTCACTTT CCCTATCTAT CCTTCACATT GGGAGTTGGC
4741 ATGAGGATCC CAGCAGCCCA TCAGGGGAGG ACTCTAGAGA TCCCTTTCCC CATTGCCTCT
4801 CCTCCCCATA CCCCCAGGCA TATCCTCCCA GGGCACGGAA GCTGAGAAGC AGTCCAGAAC
```

TABLE XXIX-continued

Nucleotide sequence in the 5' region close to 101P3A11 gene.

```
4261 CACAGTGGGC TAGTGAGGGG TACCTGCTGA TGTACCCTTT GGACAGCATT CTGCCCCACC

4921 CTGCAGGAAG AAGCAGAAGG AGGGAGAGGG TGAGGCAGAG AATAAATAAC CCTGACCAGG

4981 GAGGTCCAAG GGAGTAGGCG GAGAcagaga ggctgtattt cagtgcagcc tgccagacct
```

TABLE XXX

Promoters and their positions predicted by Neural Network Promoter Prediction computer program.

| Start | End  | Scare | Promoter Sequence |
|-------|------|-------|-------------------|
| 25    | 75   | 0.91  | TTTTGCATTTTTAATAGAGGCAGGGTTTCACCATGTTGGCCTGGCTGGTC |
| 665   | 715  | 0.95  | CAGGAAGTTGTATATAAGGAGAATCAGAGCAGAGAGAGACTAGGGTTCAG |
| 2477  | 2527 | 0.91  | TCAGTGTGCGTATATGTGAGAGAGAGGGTGCACACATGGAATACGTACTG |
| 3139  | 3189 | 0.82  | TGACATGACTCTAAGATGCCCAGTTTCTCGGCCTGGGGTCAGCCTGGGTG |
| 3420  | 3470 | 0.96  | GCCAAACATGTATAAAAGTCCTTGGTTCCCCATCTCTACTAAAAATACAA |
| 4092  | 4142 | 0.99  | AACTGATCAGTAAAAAATAAGGGGAGACCAACTAAAAACCATGTTGTTCT |
| 4953  | 5003 | 0.97  | AGGCAGAGAATAAATAACCCTGACCAGGGAGGTCCAAGGGAGTAGGCGGA |

TABLE XXXI

Alignment of five homologous 5' upstream genomic regulatory regions of the human 101P3A11 and PSA genes.

Query: 5' upstream regulatory region of the PSA gene
Subject: Putative 5' upstream regulatory region of the 101P3A11 gene.
Nucleic acid sequences predicted to be binding sites for the indicated transcription factors are bolded, underlined, or italicized.

1.
```
                  NF-1  SP-1 NF-1
Query: 3864 ccaggctggagtgcagtggcgcagtctcggctcactgcaacctctgcctcccaggttcaa 3923
            ||||||||||||||||||||  |||  | || |||
Sbjct: 3598 ccaggctggagtgcagtggcatgatctcggctcactgcaacctccaccttgcgggctcaa 3539

Query: 3924 gtgattctcctgcctcagcctcctgagttgctgggattacaggcatgcagcaccatgccc 3983
            | | |||||||||  | | ||||| |||| ||  || |||
Sbjct: 3538 gcgtttctcctgcctcagcctcccaactagctgggactacaggcacgcgccatcacaccc 3479

Query: 3984 agctaattttttgtattttttagtagagatgggg 4015
            |||||  ||||||||||||||||||||||
Sbjct: 3478 ggctaattgttgtattttttagtagagatgggg 3447
```

2.
```
                                                     SP1           NF-E
                                      NF-1   NF-1                Gr      Gr
Query: 4670 cctgtaatcccagctactgaggaggctgaggcaggagaatcacttgaacccagaaggcag 4729
            ||||| |||| | ||||||||||||| | ||| |||  |  |
Sbjct: 3496 cctgtagtcccagctagttgggaggctgaggcaggagaaacgcttgagcccgcaaggtgg 3555

Query: 4730 aggttgcaatgagccgagattgcgccactgcactccagcctgggtgacagagtgagactc 4789
            |||||| ||| ||||||||| | ||||||||||||||||||  ||||||||  |||||
Sbjct: 3556 aggttgcagtgagccgagatcatgccactgcactccagcct-ggtgacagagcaagactc 3614

Query: 4790 tgtctcaaaaaaaaaaaa 4807
            ||| ||||||||||||||
Sbjct: 3615 tgtgtcaaaaaaaaaaaa 3632
```

TABLE XXXI-continued

Alignment of five homologous 5' upstream genomic regulatory regions of the human 101P3A11 and PSA genes.

3.
```
                    GR              NF-1  SP1
Query:   142 tgagactgagtctcgctctgtgcccaggctggagtgcagtggtgcaaccttggctcactg 201
             || ||  |||| ||||  ||||||||||||||||||||    |  ||  ||||||
Sbjct:  3621 tgacacagagtcttgctctgtcaccaggctggagtgcagtggcatgatctcggctcactg 3562

Query:   202 caagctccgcctcctgggttcacgccattctcctgcctcagcctcctgagtagctgggac 261
             || ||| ||  || ||  ||  || |||||||||||||||||||  |  |||||||||||
Sbjct:  3561 caacctccaccttgcgggctcaagcgtttctcctgcctcagcctcccaactagctgggac 3502

NF-1
Query:   262 tacaggcacccgccaccacgcctggctaannnnnnngtatttttagtagagatgggg 318
             ||||||| || || || ||||                ||||||||||||||||||||
Sbjct:  3501 tacaggcacgcgccatcacacccggctaa--ttgttgtatttttagtagagatgggg 3447
```

4.
```
Query:   300 attttagtagagatgggtttcactgtgttagccaggatggtctcagtctcctgacctc 359
             |||||| ||   ||||| |||||  ||  |  ||||   |  ||||||
Sbjct:    31 attttaatagaggcagggtttcaccatgttggcctggctggtctcgaacccctgacctt 90

SP1                                    NF-1
                LF-A1                                     CP2
Query:   360 gtgatctgcccaccttggcctcccaaagtgctgggattacaggcgtgagccactgcgcct 419
             |  ||||||| |||||||||||||||||||||||||||||||||||||||||||||
Sbjct:    91 gcgatctgcccacctcggcctcccaaagtgctgggattacaggcgtgagccactgtacct 150

NF-1
Query:   420 ggc 422
             |||
Sbjct:   151 ggc 153
```

5.
```
                            NF-1
             NF-1           CP2
Query:  4506 gccaggcacagtggctcacgcctgtaatcccaacaccatgggaggctgagatgggtggat 4565
             ||||  ||||||||||||| ||||| |||  || |||
Sbjct:   153 gccaggtacagtggctcacgcctgtaatcccagcactttgggaggccgaggtgggcagat 94

Query:  4566 cacgaggtcaggagtttgagaccagcctgaccaacatggtgaaactctgtctcta 4620
             | |  ||||| || ||||||  ||||||||| ||||||||||||||| |  ||
Sbjct:    93 cgcaaggtcaggggttcgagaccagccaggccaacatggtgaaaccctgcctcta 39
```

SEQUENCE LISTING (2976 sequences)

SEQ ID NO: 1 - protein, 9 aa, Artificial Sequence
  Artificially Synthesized Peptide
GLDSLLISF

SEQ ID NO: 2 - protein, 9 aa, Artificial Sequence
  Artificially Synthesized Peptide
MVDPNGNES

SEQ ID NO: 3 - protein, 9 aa, Artificial Sequence
  Artificially Synthesized Peptide
LAFPLCSLY

SEQ ID NO: 4 - protein, 9 aa, Artificial Sequence
  Artificially Synthesized Peptide
GLEEAQFWL

SEQ ID NO: 5 - protein, 9 aa, Artificial Sequence
  Artificially Synthesized Peptide
DSLLISFSY

SEQ ID NO: 6 - protein, 9 aa, Artificial Sequence
  Artificially Synthesized Peptide
VLGNLTIIY

SEQ ID NO: 7 - protein, 9 aa, Artificial Sequence
  Artificially Synthesized Peptide
HVCAVFIFY

SEQ ID NO: 8 - protein, 9 aa, Artificial Sequence
  Artificially Synthesized Peptide
LHEPMYIFL

SEQ ID NO: 9 - protein, 9 aa, Artificial Sequence
  Artificially Synthesized Peptide
GMESTVLLA

SEQ ID NO: 10 - protein, 9 aa, Artificial Sequence
  Artificially Synthesized Peptide
GNESSATYF

SEQ ID NO: 11 - protein, 9 aa, Artificial Sequence
  Artificially Synthesized Peptide
LSMVHRFSK

SEQ ID NO: 12 - protein, 9 aa, Artificial Sequence
  Artificially Synthesized Peptide
STVLLAMAF

SEQ ID NO: 13 - protein, 9 aa, Artificial Sequence
  Artificially Synthesized Peptide
ACDDIRVNV

SEQ ID NO: 14 - protein, 9 aa, Artificial Sequence
  Artificially Synthesized Peptide
LISTSSMPK

SEQ ID NO: 15 - protein, 9 aa, Artificial Sequence
  Artificially Synthesized Peptide
MAPLPVFIK

SEQ ID NO: 16 - protein, 9 aa, Artificial Sequence
  Artificially Synthesized Peptide
SSMPKMLAI

SEQ ID NO: 17 - protein, 9 aa, Artificial Sequence
  Artificially Synthesized Peptide
RSNILSHSY

SEQ ID NO: 18 - protein, 9 aa, Artificial Sequence
  Artificially Synthesized Peptide
HATVLTLPR

SEQ ID NO: 19 - protein, 9 aa, Artificial Sequence
  Artificially Synthesized Peptide
NLTIIYIVR

SEQ ID NO: 20 - protein, 9 aa, Artificial Sequence
  Artificially Synthesized Peptide
LLAMAFDRY

SEQ ID NO: 21 - protein, 9 aa, Artificial Sequence
  Artificially Synthesized Peptide
VLLAMAFDR

SEQ ID NO: 22 - protein, 9 aa, Artificial Sequence
  Artificially Synthesized Peptide
GIDILISTS

SEQ ID NO: 23 - protein, 9 aa, Artificial Sequence
  Artificially Synthesized Peptide
TREAQAKAF

SEQ ID NO: 24 - protein, 9 aa, Artificial Sequence
  Artificially Synthesized Peptide
YCLHQDVMK

SEQ ID NO: 25 - protein, 9 aa, Artificial Sequence
  Artificially Synthesized Peptide
VLTLPRVTK

SEQ ID NO: 26 - protein, 9 aa, Artificial Sequence
  Artificially Synthesized Peptide
HQDVMKLAC

SEQ ID NO: 27 - protein, 9 aa, Artificial Sequence
  Artificially Synthesized Peptide
NGNESSATY

SEQ ID NO: 28 - protein, 9 aa, Artificial Sequence
  Artificially Synthesized Peptide
LTLPRVTKI

SEQ ID NO: 29 - protein, 9 aa, Artificial Sequence
  Artificially Synthesized Peptide
RTEHSLHEP

SEQ ID NO: 30 - protein, 9 aa, Artificial Sequence
  Artificially Synthesized Peptide
KIGVAAVVR

SEQ ID NO: 31 - protein, 9 aa, Artificial Sequence
  Artificially Synthesized Peptide
SLHEPMYIF

SEQ ID NO: 32 - protein, 9 aa, Artificial Sequence
  Artificially Synthesized Peptide
CVSHVCAVF

SEQ ID NO: 33 - protein, 9 aa, Artificial Sequence
  Artificially Synthesized Peptide
FIGLSMVHR

SEQ ID NO: 34 - protein, 9 aa, Artificial Sequence
  Artificially Synthesized Peptide
VLNPIVYGV

SEQ ID NO: 35 - protein, 9 aa, Artificial Sequence
  Artificially Synthesized Peptide
ALMAPLPVF

SEQ ID NO: 36 - protein, 9 aa, Artificial Sequence
  Artificially Synthesized Peptide
YVAICHPLR

SEQ ID NO: 37 - protein, 9 aa, Artificial Sequence
  Artificially Synthesized Peptide
AVFIFYVPF

SEQ ID NO: 38 - protein, 9 aa, Artificial Sequence
  Artificially Synthesized Peptide
LPVILANIY

SEQ ID NO: 39 - protein, 9 aa, Artificial Sequence
  Artificially Synthesized Peptide
QFDACLLQI

SEQ ID NO: 40 - protein, 9 aa, Artificial Sequence
  Artificially Synthesized Peptide
SPLPVILAN

SEQ ID NO: 41 - protein, 9 aa, Artificial Sequence
  Artificially Synthesized Peptide
ATYFILIGL

SEQ ID NO: 42 - protein, 9 aa, Artificial Sequence
  Artificially Synthesized Peptide
APLPVFIKQ

SEQ ID NO: 43 - protein, 9 aa, Artificial Sequence
  Artificially Synthesized Peptide
ICHPLRHAT

SEQ ID NO: 44 - protein, 9 aa, Artificial Sequence
  Artificially Synthesized Peptide
LMAPLPVFI

SEQ ID NO: 45 - protein, 9 aa, Artificial Sequence
  Artificially Synthesized Peptide
LVPPVLNPI

SEQ ID NO: 46 - protein, 9 aa, Artificial Sequence
  Artificially Synthesized Peptide
TSSMPKMLA

SEQ ID NO: 47 - protein, 9 aa, Artificial Sequence
  Artificially Synthesized Peptide
LSGIDILIS

SEQ ID NO: 48 - protein, 9 aa, Artificial Sequence
  Artificially Synthesized Peptide
LSHSYCLHQ

SEQ ID NO: 49 - protein, 9 aa, Artificial Sequence
  Artificially Synthesized Peptide
SSATYFILI

SEQ ID NO: 50 - protein, 9 aa, Artificial Sequence
  Artificially Synthesized Peptide
ESSATYFIL

SEQ ID NO: 51 - protein, 9 aa, Artificial Sequence
  Artificially Synthesized Peptide
FSYLLILKT

SEQ ID NO: 52 - protein, 9 aa, Artificial Sequence
  Artificially Synthesized Peptide
ISFSYLLIL

SEQ ID NO: 53 - protein, 9 aa, Artificial Sequence
  Artificially Synthesized Peptide
NSTTIQFDA

SEQ ID NO: 54 - protein, 9 aa, Artificial Sequence
  Artificially Synthesized Peptide
HSLHEPMYI

SEQ ID NO: 55 - protein, 9 aa, Artificial Sequence
  Artificially Synthesized Peptide
DSPLPVILA

SEQ ID NO: 56 - protein, 9 aa, Artificial Sequence
  Artificially Synthesized Peptide
PPVLNPIVY

SEQ ID NO: 57 - protein, 9 aa, Artificial Sequence
  Artificially Synthesized Peptide
EAQAKAFGT

SEQ ID NO: 58 - protein, 9 aa, Artificial Sequence
  Artificially Synthesized Peptide
IVIISAIGL

SEQ ID NO: 59 - protein, 9 aa, Artificial Sequence
  Artificially Synthesized Peptide
KLACDDIRV

SEQ ID NO: 60 - protein, 9 aa, Artificial Sequence
  Artificially Synthesized Peptide
DACLLQIFA

SEQ ID NO: 61 - protein, 9 aa, Artificial Sequence
  Artificially Synthesized Peptide
LPGLEEAQF

SEQ ID NO: 62 - protein, 9 aa, Artificial Sequence
  Artificially Synthesized Peptide
YVPFIGLSM

SEQ ID NO: 63 - protein, 9 aa, Artificial Sequence
  Artificially Synthesized Peptide
ACLLQIFAI

SEQ ID NO: 64 - protein, 9 aa, Artificial Sequence
  Artificially Synthesized Peptide
FIKQLPFCR

SEQ ID NO: 65 - protein, 9 aa, Artificial Sequence
  Artificially Synthesized Peptide
LCSLYLIAV

SEQ ID NO: 66 - protein, 9 aa, Artificial Sequence
  Artificially Synthesized Peptide
LNPIVYGVK

SEQ ID NO: 67 - protein, 9 aa, Artificial Sequence
  Artificially Synthesized Peptide
SMVHRFSKR

SEQ ID NO: 68 - protein, 9 aa, Artificial Sequence
  Artificially Synthesized Peptide
MLSGIDILI

SEQ ID NO: 69 - protein, 9 aa, Artificial Sequence
  Artificially Synthesized Peptide
VAICHPLRH

SEQ ID NO: 70 - protein, 9 aa, Artificial Sequence
  Artificially Synthesized Peptide
GTCVSHVCA

SEQ ID NO: 71 - protein, 9 aa, Artificial Sequence
  Artificially Synthesized Peptide
EHSLHEPMY

SEQ ID NO: 72 - protein, 9 aa, Artificial Sequence
  Artificially Synthesized Peptide
ILANIYLLV

SEQ ID NO: 73 - protein, 9 aa, Artificial Sequence
  Artificially Synthesized Peptide
LISFSYLLI

SEQ ID NO: 74 - protein, 9 aa, Artificial Sequence
  Artificially Synthesized Peptide
SFSYLLILK

SEQ ID NO: 75 - protein, 9 aa, Artificial Sequence
  Artificially Synthesized Peptide
MLAIFWFNS

SEQ ID NO: 76 - protein, 9 aa, Artificial Sequence
  Artificially Synthesized Peptide
IAVLGNLTI

SEQ ID NO: 77 - protein, 9 aa, Artificial Sequence
  Artificially Synthesized Peptide
VCAVFIFYV

SEQ ID NO: 78 - protein, 9 aa, Artificial Sequence
  Artificially Synthesized Peptide
PVFIKQLPF

SEQ ID NO: 79 - protein, 9 aa, Artificial Sequence
  Artificially Synthesized Peptide
AIGLDSLLI

SEQ ID NO: 80 - protein, 9 aa, Artificial Sequence
  Artificially Synthesized Peptide
FIFYVPFIG

SEQ ID NO: 81 - protein, 9 aa, Artificial Sequence
  Artificially Synthesized Peptide
AALMAPLPV

SEQ ID NO: 82 - protein, 9 aa, Artificial Sequence
  Artificially Synthesized Peptide
LCMLSGIDI

SEQ ID NO: 83 - protein, 9 aa, Artificial Sequence
  Artificially Synthesized Peptide
SATYFILIG

SEQ ID NO: 84 - protein, 9 aa, Artificial Sequence
  Artificially Synthesized Peptide
RRDSPLPVI

SEQ ID NO: 85 - protein, 9 aa, Artificial Sequence
  Artificially Synthesized Peptide
TTIQFDACL

SEQ ID NO: 86 - protein, 9 aa, Artificial Sequence
  Artificially Synthesized Peptide
CLHQDVMKL

SEQ ID NO: 87 - protein, 9 aa, Artificial Sequence
  Artificially Synthesized Peptide
YIFLCMLSG

SEQ ID NO: 88 - protein, 9 aa, Artificial Sequence
  Artificially Synthesized Peptide
NVVYGLIVI

SEQ ID NO: 89 - protein, 9 aa, Artificial Sequence
  Artificially Synthesized Peptide
ATVLTLPRV

SEQ ID NO: 90 - protein, 9 aa, Artificial Sequence
  Artificially Synthesized Peptide
LLQIFAIHS

SEQ ID NO: 91 - protein, 9 aa, Artificial Sequence
  Artificially Synthesized Peptide
LLVPPVLNP

SEQ ID NO: 92 - protein, 9 aa, Artificial Sequence
  Artificially Synthesized Peptide
LTIIYIVRT

SEQ ID NO: 93 - protein, 9 aa, Artificial Sequence
  Artificially Synthesized Peptide
IISAIGLDS

SEQ ID NO: 94 - protein, 9 aa, Artificial Sequence
  Artificially Synthesized Peptide
LEEAQFWLA

SEQ ID NO: 95 - protein, 9 aa, Artificial Sequence
  Artificially Synthesized Peptide
TKEIRQRIL

SEQ ID NO: 96 - protein, 9 aa, Artificial Sequence
  Artificially Synthesized Peptide
ESTVLLAMA

SEQ ID NO: 97 - protein, 9 aa, Artificial Sequence
  Artificially Synthesized Peptide
VSHVCAVFI

SEQ ID NO: 98 - protein, 9 aa, Artificial Sequence
  Artificially Synthesized Peptide
ISTSSMPKM

SEQ ID NO: 99 - protein, 9 aa, Artificial Sequence
  Artificially Synthesized Peptide
CSLYLIAVL

SEQ ID NO: 100 - protein, 9 aa, Artificial Sequence
  Artificially Synthesized Peptide
LKTVLGLTR

SEQ ID NO: 101 - protein, 10 aa, Artificial Sequence
  Artificially Synthesized Peptide
MVDPNGNESS

SEQ ID NO: 102 - protein, 10 aa, Artificial Sequence
  Artificially Synthesized Peptide
LMAPLPVFIK

SEQ ID NO: 103 - protein, 10 aa, Artificial Sequence
  Artificially Synthesized Peptide
SSMPKMLAIF

SEQ ID NO: 104 - protein, 10 aa, Artificial Sequence
  Artificially Synthesized Peptide
AVLGNLTIIY

SEQ ID NO: 105 - protein, 10 aa, Artificial Sequence
  Artificially Synthesized Peptide
CDDIRVNVVY

SEQ ID NO: 106 - protein, 10 aa, Artificial Sequence
  Artificially Synthesized Peptide
LHEPMYIFLC

SEQ ID NO: 107 - protein, 10 aa, Artificial Sequence
  Artificially Synthesized Peptide
LEEAQFWLAF

SEQ ID NO: 108 - protein, 10 aa, Artificial Sequence
  Artificially Synthesized Peptide
TKEIRQRILR

SEQ ID NO: 109 - protein, 10 aa, Artificial Sequence
  Artificially Synthesized Peptide
RTEHSLHEPM

SEQ ID NO: 110 - protein, 10 aa, Artificial Sequence
  Artificially Synthesized Peptide
GMESTVLLAM

SEQ ID NO: 111 - protein, 10 aa, Artificial Sequence
  Artificially Synthesized Peptide
VLNPIVYGVK

SEQ ID NO: 112 - protein, 10 aa, Artificial Sequence
  Artificially Synthesized Peptide
ISFSYLLILK

SEQ ID NO: 113 - protein, 10 aa, Artificial Sequence
  Artificially Synthesized Peptide
ILISTSSMPK

SEQ ID NO: 114 - protein, 10 aa, Artificial Sequence
  Artificially Synthesized Peptide
GLSMVHRFSK

SEQ ID NO: 115 - protein, 10 aa, Artificial Sequence
  Artificially Synthesized Peptide
GLEEAQFWLA

SEQ ID NO: 116 - protein, 10 aa, Artificial Sequence
  Artificially Synthesized Peptide
ESTVLLAMAF

SEQ ID NO: 117 - protein, 10 aa, Artificial Sequence
  Artificially Synthesized Peptide
VSHVCAVFIF

SEQ ID NO: 118 - protein, 10 aa, Artificial Sequence
  Artificially Synthesized Peptide
VPPVLNPIVY

SEQ ID NO: 119 - protein, 10 aa, Artificial Sequence
  Artificially Synthesized Peptide
LAFPLCSLYL

SEQ ID NO: 120 - protein, 10 aa, Artificial Sequence
  Artificially Synthesized Peptide
GIDILISTSS

SEQ ID NO: 121 - protein, 10 aa, Artificial Sequence
  Artificially Synthesized Peptide
VLLAMAFDRY

SEQ ID NO: 122 - protein, 10 aa, Artificial Sequence
  Artificially Synthesized Peptide
TVLLAMAFDR

SEQ ID NO: 123 - protein, 10 aa, Artificial Sequence
  Artificially Synthesized Peptide
GLDSLLISFS

SEQ ID NO: 124 - protein, 10 aa, Artificial Sequence
  Artificially Synthesized Peptide
ACDDIRVNVV

SEQ ID NO: 125 - protein, 10 aa, Artificial Sequence
  Artificially Synthesized Peptide
WLAFPLCSLY

SEQ ID NO: 126 - protein, 10 aa, Artificial Sequence
  Artificially Synthesized Peptide
GNESSATYFI

SEQ ID NO: 127 - protein, 10 aa, Artificial Sequence
  Artificially Synthesized Peptide
TVLTLPRVTK

SEQ ID NO: 128 - protein, 10 aa, Artificial Sequence
  Artificially Synthesized Peptide
HSLHEPMYIF

SEQ ID NO: 129 - protein, 10 aa, Artificial Sequence
  Artificially Synthesized Peptide
QFDACLLQIF

SEQ ID NO: 130 - protein, 10 aa, Artificial Sequence
  Artificially Synthesized Peptide
LTLPRVTKIG

SEQ ID NO: 131 - protein, 10 aa, Artificial Sequence
  Artificially Synthesized Peptide
ICHPLRHATV

SEQ ID NO: 132 - protein, 10 aa, Artificial Sequence
  Artificially Synthesized Peptide
AALMAPLPVF

SEQ ID NO: 133 - protein, 10 aa, Artificial Sequence
  Artificially Synthesized Peptide
CAVFIFYVPF

SEQ ID NO: 134 - protein, 10 aa, Artificial Sequence
  Artificially Synthesized Peptide
LVPPVLNPIV

SEQ ID NO: 135 - protein, 10 aa, Artificial Sequence
  Artificially Synthesized Peptide
TCVSHVCAVF

SEQ ID NO: 136 - protein, 10 aa, Artificial Sequence
  Artificially Synthesized Peptide
GLPGLEEAQF

SEQ ID NO: 137 - protein, 10 aa, Artificial Sequence
  Artificially Synthesized Peptide
LSMVHRFSKR

SEQ ID NO: 138 - protein, 10 aa, Artificial Sequence
  Artificially Synthesized Peptide
GNLTIIYIVR

SEQ ID NO: 139 - protein, 10 aa, Artificial Sequence
  Artificially Synthesized Peptide
SHVCAVFIFY

SEQ ID NO: 140 - protein, 10 aa, Artificial Sequence
  Artificially Synthesized Peptide
IGLDSLLISF

SEQ ID NO: 141 - protein, 10 aa, Artificial Sequence
  Artificially Synthesized Peptide
LPVFIKQLPF

SEQ ID NO: 142 - protein, 10 aa, Artificial Sequence
  Artificially Synthesized Peptide
LDSLLISFSY

SEQ ID NO: 143 - protein, 10 aa, Artificial Sequence
  Artificially Synthesized Peptide
STSSMPKMLA

SEQ ID NO: 144 - protein, 10 aa, Artificial Sequence
  Artificially Synthesized Peptide
FIGLSMVHRF

SEQ ID NO: 145 - protein, 10 aa, Artificial Sequence
  Artificially Synthesized Peptide
LLVPPVLNPI

SEQ ID NO: 146 - protein, 10 aa, Artificial Sequence
  Artificially Synthesized Peptide
TREAQAKAFG

SEQ ID NO: 147 - protein, 10 aa, Artificial Sequence
  Artificially Synthesized Peptide
TSSMPKMLAI

SEQ ID NO: 148 - protein, 10 aa, Artificial Sequence
  Artificially Synthesized Peptide
DSPLPVILAN

SEQ ID NO: 149 - protein, 10 aa, Artificial Sequence
  Artificially Synthesized Peptide
ESSATYFILI

SEQ ID NO: 150 - protein, 10 aa, Artificial Sequence
  Artificially Synthesized Peptide
LSGIDILIST

SEQ ID NO: 151 - protein, 10 aa, Artificial Sequence
  Artificially Synthesized Peptide
SSATYFILIG

SEQ ID NO: 152 - protein, 10 aa, Artificial Sequence
  Artificially Synthesized Peptide
PLPVILANIY

SEQ ID NO: 153 - protein, 10 aa, Artificial Sequence
  Artificially Synthesized Peptide
LLISFSYLLI

SEQ ID NO: 154 - protein, 10 aa, Artificial Sequence
  Artificially Synthesized Peptide
HVCAVFIFYV

SEQ ID NO: 155 - protein, 10 aa, Artificial Sequence
  Artificially Synthesized Peptide
ILSHSYCLHQ

SEQ ID NO: 156 - protein, 10 aa, Artificial Sequence
  Artificially Synthesized Peptide
NPIVYGVKTK

SEQ ID NO: 157 - protein, 10 aa, Artificial Sequence
  Artificially Synthesized Peptide
VLGNLTIIYI

SEQ ID NO: 158 - protein, 10 aa, Artificial Sequence
  Artificially Synthesized Peptide
AIHSLSGMES

SEQ ID NO: 159 - protein, 10 aa, Artificial Sequence
  Artificially Synthesized Peptide
YVAICHPLRH

SEQ ID NO: 160 - protein, 10 aa, Artificial Sequence
  Artificially Synthesized Peptide
LIVIISAIGL

SEQ ID NO: 161 - protein, 10 aa, Artificial Sequence
  Artificially Synthesized Peptide
SMVHRFSKRR

SEQ ID NO: 162 - protein, 10 aa, Artificial Sequence
  Artificially Synthesized Peptide
DACLLQIFAI

SEQ ID NO: 163 - protein, 10 aa, Artificial Sequence
  Artificially Synthesized Peptide
SLHEPMYIFL

SEQ ID NO: 164 - protein, 10 aa, Artificial Sequence
  Artificially Synthesized Peptide
SLYLIAVLGN

SEQ ID NO: 165 - protein, 10 aa, Artificial Sequence
  Artificially Synthesized Peptide
RVNVVYGLIV

SEQ ID NO: 166 - protein, 10 aa, Artificial Sequence
  Artificially Synthesized Peptide
LISFSYLLIL

SEQ ID NO: 167 - protein, 10 aa, Artificial Sequence
  Artificially Synthesized Peptide
LLILKTVLGL

SEQ ID NO: 168 - protein, 10 aa, Artificial Sequence
  Artificially Synthesized Peptide
MLSGIDILIS

SEQ ID NO: 169 - protein, 10 aa, Artificial Sequence
  Artificially Synthesized Peptide
RRDSPLPVIL

SEQ ID NO: 170 - protein, 10 aa, Artificial Sequence
  Artificially Synthesized Peptide
SPLPVILANI

SEQ ID NO: 171 - protein, 10 aa, Artificial Sequence
  Artificially Synthesized Peptide
SAIGLDSLLI

SEQ ID NO: 172 - protein, 10 aa, Artificial Sequence
  Artificially Synthesized Peptide
QIFAIHSLSG

SEQ ID NO: 173 - protein, 10 aa, Artificial Sequence
  Artificially Synthesized Peptide
FLCMLSGIDI

SEQ ID NO: 174 - protein, 10 aa, Artificial Sequence
  Artificially Synthesized Peptide
AIGLDSLLIS

SEQ ID NO: 175 - protein, 10 aa, Artificial Sequence
  Artificially Synthesized Peptide
VIISAIGLDS

SEQ ID NO: 176 - protein, 10 aa, Artificial Sequence
  Artificially Synthesized Peptide
TIQFDACLLQ

SEQ ID NO: 177 - protein, 10 aa, Artificial Sequence
  Artificially Synthesized Peptide
VILANIYLLV

SEQ ID NO: 178 - protein, 10 aa, Artificial Sequence
  Artificially Synthesized Peptide
SATYFILIGL

SEQ ID NO: 179 - protein, 10 aa, Artificial Sequence
  Artificially Synthesized Peptide
VVYGLIVIIS

SEQ ID NO: 180 - protein, 10 aa, Artificial Sequence
  Artificially Synthesized Peptide
EAQFWLAFPL

SEQ ID NO: 181 - protein, 10 aa, Artificial Sequence
  Artificially Synthesized Peptide
GAALMAPLPV

SEQ ID NO: 182 - protein, 10 aa, Artificial Sequence
  Artificially Synthesized Peptide
STTIQFDACL

SEQ ID NO: 183 - protein, 10 aa, Artificial Sequence
  Artificially Synthesized Peptide
LGLTREAQAK

SEQ ID NO: 184 - protein, 10 aa, Artificial Sequence
  Artificially Synthesized Peptide
CLLQIFAIHS

SEQ ID NO: 185 - protein, 10 aa, Artificial Sequence
  Artificially Synthesized Peptide
LIAVLGNLTI

SEQ ID NO: 186 - protein, 10 aa, Artificial Sequence
  Artificially Synthesized Peptide
TEHSLHEPMY

SEQ ID NO: 187 - protein, 10 aa, Artificial Sequence
  Artificially Synthesized Peptide
ILKTVLGLTR

SEQ ID NO: 188 - protein, 10 aa, Artificial Sequence
  Artificially Synthesized Peptide
MAPLPVFIKQ

SEQ ID NO: 189 - protein, 10 aa, Artificial Sequence
  Artificially Synthesized Peptide
FIFYVPFIGL

SEQ ID NO: 190 - protein, 10 aa, Artificial Sequence
  Artificially Synthesized Peptide
YCLHQDVMKL

SEQ ID NO: 191 - protein, 10 aa, Artificial Sequence
  Artificially Synthesized Peptide
LSGMESTVLL

SEQ ID NO: 192 - protein, 10 aa, Artificial Sequence
  Artificially Synthesized Peptide
CSLYLIAVLG

SEQ ID NO: 193 - protein, 10 aa, Artificial Sequence
  Artificially Synthesized Peptide
KTVLGLTREA

SEQ ID NO: 194 - protein, 10 aa, Artificial Sequence
  Artificially Synthesized Peptide
NGNESSATYF

SEQ ID NO: 195 - protein, 10 aa, Artificial Sequence
  Artificially Synthesized Peptide
LTREAQAKAF

SEQ ID NO: 196 - protein, 10 aa, Artificial Sequence
  Artificially Synthesized Peptide
CRSNILSHSY

SEQ ID NO: 197 - protein, 10 aa, Artificial Sequence
  Artificially Synthesized Peptide
FWFNSTTIQF

SEQ ID NO: 198 - protein, 10 aa, Artificial Sequence
  Artificially Synthesized Peptide
IGLPGLEEAQ

SEQ ID NO: 199 - protein, 10 aa, Artificial Sequence
  Artificially Synthesized Peptide
KMLAIFWFNS

SEQ ID NO: 200 - protein, 10 aa, Artificial Sequence
  Artificially Synthesized Peptide
PNGNESSATY

SEQ ID NO: 201 - protein, 9 aa, Artificial Sequence
  Artificially Synthesized Peptide
SLLISFSYL

SEQ ID NO: 202 - protein, 9 aa, Artificial Sequence
  Artificially Synthesized Peptide
VLNPIVYGV

SEQ ID NO: 203 - protein, 9 aa, Artificial Sequence
  Artificially Synthesized Peptide
KLACDDIRV

SEQ ID NO: 204 - protein, 9 aa, Artificial Sequence
  Artificially Synthesized Peptide
WLAFPLCSL

SEQ ID NO: 205 - protein, 9 aa, Artificial Sequence
  Artificially Synthesized Peptide
VCAVFIFYV

SEQ ID NO: 206 - protein, 9 aa, Artificial Sequence
  Artificially Synthesized Peptide
GLEEAQFWL

SEQ ID NO: 207 - protein, 9 aa, Artificial Sequence
  Artificially Synthesized Peptide
ILANIYLLV

SEQ ID NO: 208 - protein, 9 aa, Artificial Sequence
  Artificially Synthesized Peptide
YLLILKTVL

SEQ ID NO: 209 - protein, 9 aa, Artificial Sequence
  Artificially Synthesized Peptide
LLISFSYLL

SEQ ID NO: 210 - protein, 9 aa, Artificial Sequence
  Artificially Synthesized Peptide
FILIGLPGL

SEQ ID NO: 211 - protein, 9 aa, Artificial Sequence
  Artificially Synthesized Peptide
LMAPLPVFI

SEQ ID NO: 212 - protein, 9 aa, Artificial Sequence
  Artificially Synthesized Peptide
NIYLLVPPV

SEQ ID NO: 213 - protein, 9 aa, Artificial Sequence
  Artificially Synthesized Peptide
SLSGMESTV

SEQ ID NO: 214 - protein, 9 aa, Artificial Sequence
  Artificially Synthesized Peptide
KMLAIFWFN

SEQ ID NO: 215 - protein, 9 aa, Artificial Sequence
  Artificially Synthesized Peptide
CLHQDVMKL

SEQ ID NO: 216 - protein, 9 aa, Artificial Sequence
  Artificially Synthesized Peptide
AQFWLAFPL

SEQ ID NO: 217 - protein, 9 aa, Artificial Sequence
  Artificially Synthesized Peptide
VILANIYLL

SEQ ID NO: 218 - protein, 9 aa, Artificial Sequence
  Artificially Synthesized Peptide
LILKTVLGL

SEQ ID NO: 219 - protein, 9 aa, Artificial Sequence
  Artificially Synthesized Peptide
YLIAVLGNL

SEQ ID NO: 220 - protein, 9 aa, Artificial Sequence
  Artificially Synthesized Peptide
CMLSGIDIL

SEQ ID NO: 221 - protein, 9 aa, Artificial Sequence
  Artificially Synthesized Peptide
LAMAFDRYV

SEQ ID NO: 222 - protein, 9 aa, Artificial Sequence
  Artificially Synthesized Peptide
GLIVIISAI

SEQ ID NO: 223 - protein, 9 aa, Artificial Sequence
  Artificially Synthesized Peptide
RLFHVATHA

SEQ ID NO: 224 - protein, 9 aa, Artificial Sequence
  Artificially Synthesized Peptide
MLSGIDILI

SEQ ID NO: 225 - protein, 9 aa, Artificial Sequence
  Artificially Synthesized Peptide
AIFWFNSTT

SEQ ID NO: 226 - protein, 9 aa, Artificial Sequence
  Artificially Synthesized Peptide
YIVRTEHSL

SEQ ID NO: 227 - protein, 9 aa, Artificial Sequence
  Artificially Synthesized Peptide
NILSHSYCL

SEQ ID NO: 228 - protein, 9 aa, Artificial Sequence
  Artificially Synthesized Peptide
QLPFCRSNI

SEQ ID NO: 229 - protein, 9 aa, Artificial Sequence
  Artificially Synthesized Peptide
PMYIFLCML

SEQ ID NO: 230 - protein, 9 aa, Artificial Sequence
  Artificially Synthesized Peptide
LQIFAIHSL

SEQ ID NO: 231 - protein, 9 aa, Artificial Sequence
  Artificially Synthesized Peptide
VPFIGLSMV

SEQ ID NO: 232 - protein, 9 aa, Artificial Sequence
  Artificially Synthesized Peptide
MAFDRYVAI

SEQ ID NO: 233 - protein, 9 aa, Artificial Sequence
  Artificially Synthesized Peptide
MLAIFWFNS

SEQ ID NO: 234 - protein, 9 aa, Artificial Sequence
  Artificially Synthesized Peptide
VVYGLIVII

SEQ ID NO: 235 - protein, 9 aa, Artificial Sequence
  Artificially Synthesized Peptide
PLPVFIKQL

SEQ ID NO: 236 - protein, 9 aa, Artificial Sequence
  Artificially Synthesized Peptide
ILRLFHVAT

SEQ ID NO: 237 - protein, 9 aa, Artificial Sequence
  Artificially Synthesized Peptide
LISFSYLLI

SEQ ID NO: 238 - protein, 9 aa, Artificial Sequence
  Artificially Synthesized Peptide
AALMAPLPV

SEQ ID NO: 239 - protein, 9 aa, Artificial Sequence
  Artificially Synthesized Peptide
LVPPVLNPI

SEQ ID NO: 240 - protein, 9 aa, Artificial Sequence
  Artificially Synthesized Peptide
ACLLQIFAI

SEQ ID NO: 241 - protein, 9 aa, Artificial Sequence
  Artificially Synthesized Peptide
AVLGNLTII

SEQ ID NO: 242 - protein, 9 aa, Artificial Sequence
  Artificially Synthesized Peptide
IVIISAIGL

SEQ ID NO: 243 - protein, 9 aa, Artificial Sequence
  Artificially Synthesized Peptide
TIQFDACLL

SEQ ID NO: 244 - protein, 9 aa, Artificial Sequence
  Artificially Synthesized Peptide
FPLCSLYLI

SEQ ID NO: 245 - protein, 9 aa, Artificial Sequence
  Artificially Synthesized Peptide
ATVLTLPRV

SEQ ID NO: 246 - protein, 9 aa, Artificial Sequence
  Artificially Synthesized Peptide
ATYFILIGL

SEQ ID NO: 247 - protein, 9 aa, Artificial Sequence
  Artificially Synthesized Peptide
SGMESTVLL

SEQ ID NO: 248 - protein, 9 aa, Artificial Sequence
  Artificially Synthesized Peptide
LTLPRVTKI

SEQ ID NO: 249 - protein, 9 aa, Artificial Sequence
  Artificially Synthesized Peptide
YVPFIGLSM

SEQ ID NO: 250 - protein, 9 aa, Artificial Sequence
  Artificially Synthesized Peptide
RILRLFHVA

SEQ ID NO: 251 - protein, 9 aa, Artificial Sequence
  Artificially Synthesized Peptide
LCSLYLIAV

SEQ ID NO: 252 - protein, 9 aa, Artificial Sequence
  Artificially Synthesized Peptide
LIAVLGNLT

SEQ ID NO: 253 - protein, 9 aa, Artificial Sequence
  Artificially Synthesized Peptide
FSYLLILKT

SEQ ID NO: 254 - protein, 9 aa, Artificial Sequence
  Artificially Synthesized Peptide
GNLTIIYIV

SEQ ID NO: 255 - protein, 9 aa, Artificial Sequence
  Artificially Synthesized Peptide
AMAFDRYVA

SEQ ID NO: 256 - protein, 9 aa, Artificial Sequence
  Artificially Synthesized Peptide
LGNLTIIYI

SEQ ID NO: 257 - protein, 9 aa, Artificial Sequence
  Artificially Synthesized Peptide
AIGLDSLLI

SEQ ID NO: 258 - protein, 9 aa, Artificial Sequence
  Artificially Synthesized Peptide
YGLIVIISA

SEQ ID NO: 259 - protein, 9 aa, Artificial Sequence
  Artificially Synthesized Peptide
YLLVPPVLN

SEQ ID NO: 260 - protein, 9 aa, Artificial Sequence
  Artificially Synthesized Peptide
TTIQFDACL

SEQ ID NO: 261 - protein, 9 aa, Artificial Sequence
  Artificially Synthesized Peptide
NESSATYFI

SEQ ID NO: 262 - protein, 9 aa, Artificial Sequence
  Artificially Synthesized Peptide
TCVSHVCAV

SEQ ID NO: 263 - protein, 9 aa, Artificial Sequence
  Artificially Synthesized Peptide
NVVYGLIVI

SEQ ID NO: 264 - protein, 9 aa, Artificial Sequence
  Artificially Synthesized Peptide
ISFSYLLIL

SEQ ID NO: 265 - protein, 9 aa, Artificial Sequence
  Artificially Synthesized Peptide
ACDDIRVNV

SEQ ID NO: 266 - protein, 9 aa, Artificial Sequence
  Artificially Synthesized Peptide
FAIHSLSGM

SEQ ID NO: 267 - protein, 9 aa, Artificial Sequence
  Artificially Synthesized Peptide
VSHVCAVFI

SEQ ID NO: 268 - protein, 9 aa, Artificial Sequence
  Artificially Synthesized Peptide
SSMPKMLAI

SEQ ID NO: 269 - protein, 9 aa, Artificial Sequence
  Artificially Synthesized Peptide
VLLAMAFDR

SEQ ID NO: 270 - protein, 9 aa, Artificial Sequence
  Artificially Synthesized Peptide
GMESTVLLA

SEQ ID NO: 271 - protein, 9 aa, Artificial Sequence
  Artificially Synthesized Peptide
PLPVILANI

SEQ ID NO: 272 - protein, 9 aa, Artificial Sequence
  Artificially Synthesized Peptide
CSLYLIAVL

SEQ ID NO: 273 - protein, 9 aa, Artificial Sequence
  Artificially Synthesized Peptide
LLQIFAIHS

SEQ ID NO: 274 - protein, 9 aa, Artificial Sequence
  Artificially Synthesized Peptide
SGIDILIST

SEQ ID NO: 275 - protein, 9 aa, Artificial Sequence
  Artificially Synthesized Peptide
RVTKIGVAA

SEQ ID NO: 276 - protein, 9 aa, Artificial Sequence
  Artificially Synthesized Peptide
AVVRGAALM

SEQ ID NO: 277 - protein, 9 aa, Artificial Sequence
  Artificially Synthesized Peptide
LCMLSGIDI

SEQ ID NO: 278 - protein, 9 aa, Artificial Sequence
  Artificially Synthesized Peptide
FIFYVPFIG

SEQ ID NO: 279 - protein, 9 aa, Artificial Sequence
  Artificially Synthesized Peptide
LTIIYIVRT

SEQ ID NO: 280 - protein, 9 aa, Artificial Sequence
  Artificially Synthesized Peptide
YIFLCMLSG

SEQ ID NO: 281 - protein, 9 aa, Artificial Sequence
  Artificially Synthesized Peptide
MESTVLLAM

SEQ ID NO: 282 - protein, 9 aa, Artificial Sequence
  Artificially Synthesized Peptide
LPFCRSNIL

SEQ ID NO: 283 - protein, 9 aa, Artificial Sequence
  Artificially Synthesized Peptide
LAIFWFNST

SEQ ID NO: 284 - protein, 9 aa, Artificial Sequence
  Artificially Synthesized Peptide
TVLGLTREA

SEQ ID NO: 285 - protein, 9 aa, Artificial Sequence
  Artificially Synthesized Peptide
RGAALMAPL

SEQ ID NO: 286 - protein, 9 aa, Artificial Sequence
  Artificially Synthesized Peptide
VPPVLNPIV

SEQ ID NO: 287 - protein, 9 aa, Artificial Sequence
  Artificially Synthesized Peptide
VNVVYGLIV

SEQ ID NO: 288 - protein, 9 aa, Artificial Sequence
  Artificially Synthesized Peptide
AICHPLRHA

SEQ ID NO: 289 - protein, 9 aa, Artificial Sequence
  Artificially Synthesized Peptide
AAVVRGAAL

SEQ ID NO: 290 - protein, 9 aa, Artificial Sequence
  Artificially Synthesized Peptide
SAIGLDSLL

SEQ ID NO: 291 - protein, 9 aa, Artificial Sequence
  Artificially Synthesized Peptide
STSSMPKML

SEQ ID NO: 292 - protein, 9 aa, Artificial Sequence
  Artificially Synthesized Peptide
SLHEPMYIF

SEQ ID NO: 293 - protein, 9 aa, Artificial Sequence
  Artificially Synthesized Peptide
ISAIGLDSL

SEQ ID NO: 294 - protein, 9 aa, Artificial Sequence
  Artificially Synthesized Peptide
ALMAPLPVF

SEQ ID NO: 295 - protein, 9 aa, Artificial Sequence
  Artificially Synthesized Peptide
IAVLGNLTI

SEQ ID NO: 296 - protein, 9 aa, Artificial Sequence
  Artificially Synthesized Peptide
SLYLIAVLG

SEQ ID NO: 297 - protein, 9 aa, Artificial Sequence
  Artificially Synthesized Peptide
IGLPGLEEA

SEQ ID NO: 298 - protein, 9 aa, Artificial Sequence
  Artificially Synthesized Peptide
PVILANIYL

SEQ ID NO: 299 - protein, 9 aa, Artificial Sequence
  Artificially Synthesized Peptide
VMKLACDDI

SEQ ID NO: 300 - protein, 9 aa, Artificial Sequence
  Artificially Synthesized Peptide
CLLQIFAIH

SEQ ID NO: 301 - protein, 10 aa, Artificial Sequence
  Artificially Synthesized Peptide
SLHEPMYIFL

SEQ ID NO: 302 - protein, 10 aa, Artificial Sequence
  Artificially Synthesized Peptide
LLAMAFDRYV

SEQ ID NO: 303 - protein, 10 aa, Artificial Sequence
  Artificially Synthesized Peptide
SLLISFSYLL

SEQ ID NO: 304 - protein, 10 aa, Artificial Sequence
  Artificially Synthesized Peptide
VLGNLTIIYI

SEQ ID NO: 305 - protein, 10 aa, Artificial Sequence
  Artificially Synthesized Peptide
ALMAPLPVFI

SEQ ID NO: 306 - protein, 10 aa, Artificial Sequence
  Artificially Synthesized Peptide
FIFYVPFIGL

SEQ ID NO: 307 - protein, 10 aa, Artificial Sequence
  Artificially Synthesized Peptide
VILANIYLLV

SEQ ID NO: 308 - protein, 10 aa, Artificial Sequence
  Artificially Synthesized Peptide
LLILKTVLGL

SEQ ID NO: 309 - protein, 10 aa, Artificial Sequence
  Artificially Synthesized Peptide
LLQIFAIHSL

SEQ ID NO: 310 - protein, 10 aa, Artificial Sequence
  Artificially Synthesized Peptide
TLPRVTKIGV

SEQ ID NO: 311 - protein, 10 aa, Artificial Sequence
  Artificially Synthesized Peptide
YVPFIGLSMV

SEQ ID NO: 312 - protein, 10 aa, Artificial Sequence
  Artificially Synthesized Peptide
IQFDACLLQI

SEQ ID NO: 313 - protein, 10 aa, Artificial Sequence
  Artificially Synthesized Peptide
HVCAVFIFYV

SEQ ID NO: 314 - protein, 10 aa, Artificial Sequence
  Artificially Synthesized Peptide
YIFLCMLSGI

SEQ ID NO: 315 - protein, 10 aa, Artificial Sequence
  Artificially Synthesized Peptide
FLCMLSGIDI

SEQ ID NO: 316 - protein, 10 aa, Artificial Sequence
  Artificially Synthesized Peptide
AVFIFYVPFI

SEQ ID NO: 317 - protein, 10 aa, Artificial Sequence
  Artificially Synthesized Peptide
VLTLPRVTKI

SEQ ID NO: 318 - protein, 10 aa, Artificial Sequence
  Artificially Synthesized Peptide
LLVPPVLNPI

SEQ ID NO: 319 - protein, 10 aa, Artificial Sequence
  Artificially Synthesized Peptide
YLIAVLGNLT

SEQ ID NO: 320 - protein, 10 aa, Artificial Sequence
  Artificially Synthesized Peptide
KAFGTCVSHV

SEQ ID NO: 321 - protein, 10 aa, Artificial Sequence
  Artificially Synthesized Peptide
CMLSGIDILI

SEQ ID NO: 322 - protein, 10 aa, Artificial Sequence
  Artificially Synthesized Peptide
AQAKAFGTCV

SEQ ID NO: 323 - protein, 10 aa, Artificial Sequence
  Artificially Synthesized Peptide
LLISFSYLLI

SEQ ID NO: 324 - protein, 10 aa, Artificial Sequence
  Artificially Synthesized Peptide
KMLAIFWFNS

SEQ ID NO: 325 - protein, 10 aa, Artificial Sequence
  Artificially Synthesized Peptide
MLAIFWFNST

SEQ ID NO: 326 - protein, 10 aa, Artificial Sequence
  Artificially Synthesized Peptide
GLEEAQFWLA

SEQ ID NO: 327 - protein, 10 aa, Artificial Sequence
  Artificially Synthesized Peptide
NLTIIYIVRT

SEQ ID NO: 328 - protein, 10 aa, Artificial Sequence
  Artificially Synthesized Peptide
FSYLLILKTV

SEQ ID NO: 329 - protein, 10 aa, Artificial Sequence
  Artificially Synthesized Peptide
RILRLFHVAT

SEQ ID NO: 330 - protein, 10 aa, Artificial Sequence
  Artificially Synthesized Peptide
RVTKIGVAAV

SEQ ID NO: 331 - protein, 10 aa, Artificial Sequence
  Artificially Synthesized Peptide
KQLPFCRSNI

SEQ ID NO: 332 - protein, 10 aa, Artificial Sequence
  Artificially Synthesized Peptide
CLHQDVMKLA

SEQ ID NO: 333 - protein, 10 aa, Artificial Sequence
  Artificially Synthesized Peptide
AMAFDRYVAI

SEQ ID NO: 334 - protein, 10 aa, Artificial Sequence
  Artificially Synthesized Peptide
LAFPLCSLYL

SEQ ID NO: 335 - protein, 10 aa, Artificial Sequence
  Artificially Synthesized Peptide
SLSGMESTVL

SEQ ID NO: 336 - protein, 10 aa, Artificial Sequence
  Artificially Synthesized Peptide
QLPFCRSNIL

SEQ ID NO: 337 - protein, 10 aa, Artificial Sequence
  Artificially Synthesized Peptide
VLGLTREAQA

SEQ ID NO: 338 - protein, 10 aa, Artificial Sequence
  Artificially Synthesized Peptide
RQRILRLFHV

SEQ ID NO: 339 - protein, 10 aa, Artificial Sequence
  Artificially Synthesized Peptide
LACDDIRVNV

SEQ ID NO: 340 - protein, 10 aa, Artificial Sequence
  Artificially Synthesized Peptide
IISAIGLDSL

SEQ ID NO: 341 - protein, 10 aa, Artificial Sequence
  Artificially Synthesized Peptide
YCLHQDVMKL

SEQ ID NO: 342 - protein, 10 aa, Artificial Sequence
  Artificially Synthesized Peptide
AIFWFNSTTI

SEQ ID NO: 343 - protein, 10 aa, Artificial Sequence
  Artificially Synthesized Peptide
CVSHVCAVFI

SEQ ID NO: 344 - protein, 10 aa, Artificial Sequence
  Artificially Synthesized Peptide
LIVIISAIGL

SEQ ID NO: 345 - protein, 10 aa, Artificial Sequence
  Artificially Synthesized Peptide
GLTREAQAKA

SEQ ID NO: 346 - protein, 10 aa, Artificial Sequence
  Artificially Synthesized Peptide
IVYGVKTKEI

SEQ ID NO: 347 - protein, 10 aa, Artificial Sequence
  Artificially Synthesized Peptide
LISFSYLLIL

SEQ ID NO: 348 - protein, 10 aa, Artificial Sequence
  Artificially Synthesized Peptide
APLPVFIKQL

SEQ ID NO: 349 - protein, 10 aa, Artificial Sequence
  Artificially Synthesized Peptide
LVPPVLNPIV

SEQ ID NO: 350 - protein, 10 aa, Artificial Sequence
  Artificially Synthesized Peptide
NIYLLVPPVL

SEQ ID NO: 351 - protein, 10 aa, Artificial Sequence
  Artificially Synthesized Peptide
AQFWLAFPLC

SEQ ID NO: 352 - protein, 10 aa, Artificial Sequence
  Artificially Synthesized Peptide
PLCSLYLIAV

SEQ ID NO: 353 - protein, 10 aa, Artificial Sequence
  Artificially Synthesized Peptide
KEIRQRILRL

SEQ ID NO: 354 - protein, 10 aa, Artificial Sequence
  Artificially Synthesized Peptide
LISTSSMPKM

SEQ ID NO: 355 - protein, 10 aa, Artificial Sequence
  Artificially Synthesized Peptide
YGLIVIISAI

SEQ ID NO: 356 - protein, 10 aa, Artificial Sequence
  Artificially Synthesized Peptide
RVNVVYGLIV

SEQ ID NO: 357 - protein, 10 aa, Artificial Sequence
  Artificially Synthesized Peptide
LIAVLGNLTI

SEQ ID NO: 358 - protein, 10 aa, Artificial Sequence
  Artificially Synthesized Peptide
GTCVSHVCAV

SEQ ID NO: 359 - protein, 10 aa, Artificial Sequence
  Artificially Synthesized Peptide
LILKTVLGLT

SEQ ID NO: 360 - protein, 10 aa, Artificial Sequence
  Artificially Synthesized Peptide
MAFDRYVAIC

SEQ ID NO: 361 - protein, 10 aa, Artificial Sequence
  Artificially Synthesized Peptide
PGLEEAQFWL

SEQ ID NO: 362 - protein, 10 aa, Artificial Sequence
  Artificially Synthesized Peptide
NESSATYFIL

SEQ ID NO: 363 - protein, 10 aa, Artificial Sequence
  Artificially Synthesized Peptide
LIGLPGLEEA

SEQ ID NO: 364 - protein, 10 aa, Artificial Sequence
  Artificially Synthesized Peptide
LPVILANIYL

SEQ ID NO: 365 - protein, 10 aa, Artificial Sequence
  Artificially Synthesized Peptide
YLLILKTVLG

SEQ ID NO: 366 - protein, 10 aa, Artificial Sequence
  Artificially Synthesized Peptide
PVLNPIVYGV

SEQ ID NO: 367 - protein, 10 aa, Artificial Sequence
  Artificially Synthesized Peptide
SGMESTVLLA

SEQ ID NO: 368 - protein, 10 aa, Artificial Sequence
  Artificially Synthesized Peptide
STTIQFDACL

SEQ ID NO: 369 - protein, 10 aa, Artificial Sequence
  Artificially Synthesized Peptide
CLLQIFAIHS

SEQ ID NO: 370 - protein, 10 aa, Artificial Sequence
  Artificially Synthesized Peptide
ANIYLLVPPV

SEQ ID NO: 371 - protein, 10 aa, Artificial Sequence
  Artificially Synthesized Peptide
AICHPLRHAT

SEQ ID NO: 372 - protein, 10 aa, Artificial Sequence
  Artificially Synthesized Peptide
GAALMAPLPV

SEQ ID NO: 373 - protein, 10 aa, Artificial Sequence
  Artificially Synthesized Peptide
FNSTTIQFDA

SEQ ID NO: 374 - protein, 10 aa, Artificial Sequence
  Artificially Synthesized Peptide
NVVYGLIVII

SEQ ID NO: 375 - protein, 10 aa, Artificial Sequence
  Artificially Synthesized Peptide
REAQAKAFGT

SEQ ID NO: 376 - protein, 10 aa, Artificial Sequence
  Artificially Synthesized Peptide
ICHPLRHATV

SEQ ID NO: 377 - protein, 10 aa, Artificial Sequence
  Artificially Synthesized Peptide
LGNLTIIYIV

SEQ ID NO: 378 - protein, 10 aa, Artificial Sequence
  Artificially Synthesized Peptide
ACDDIRVNVV

SEQ ID NO: 379 - protein, 10 aa, Artificial Sequence
  Artificially Synthesized Peptide
SATYFILIGL

SEQ ID NO: 380 - protein, 10 aa, Artificial Sequence
  Artificially Synthesized Peptide
LAIFWFNSTT

SEQ ID NO: 381 - protein, 10 aa, Artificial Sequence
  Artificially Synthesized Peptide
MKLACDDIRV

SEQ ID NO: 382 - protein, 10 aa, Artificial Sequence
  Artificially Synthesized Peptide
YLLVPPVLNP

SEQ ID NO: 383 - protein, 10 aa, Artificial Sequence
  Artificially Synthesized Peptide
SPLPVILANI

SEQ ID NO: 384 - protein, 10 aa, Artificial Sequence
  Artificially Synthesized Peptide
SLYLIAVLGN

SEQ ID NO: 385 - protein, 10 aa, Artificial Sequence
  Artificially Synthesized Peptide
GMESTVLLAM

SEQ ID NO: 386 - protein, 10 aa, Artificial Sequence
  Artificially Synthesized Peptide
VAAVVRGAAL

SEQ ID NO: 387 - protein, 10 aa, Artificial Sequence
  Artificially Synthesized Peptide
PVFIKQLPFC

SEQ ID NO: 388 - protein, 10 aa, Artificial Sequence
  Artificially Synthesized Peptide
VLLAMAFDRY

SEQ ID NO: 389 - protein, 10 aa, Artificial Sequence
  Artificially Synthesized Peptide
AVVRGAALMA

SEQ ID NO: 390 - protein, 10 aa, Artificial Sequence
  Artificially Synthesized Peptide
LCMLSGIDIL

SEQ ID NO: 391 - protein, 10 aa, Artificial Sequence
  Artificially Synthesized Peptide
DSLLISFSYL

SEQ ID NO: 392 - protein, 10 aa, Artificial Sequence
  Artificially Synthesized Peptide
MESTVLLAMA

SEQ ID NO: 393 - protein, 10 aa, Artificial Sequence
  Artificially Synthesized Peptide
GLDSLLISFS

SEQ ID NO: 394 - protein, 10 aa, Artificial Sequence
  Artificially Synthesized Peptide
WLAFPLCSLY

SEQ ID NO: 395 - protein, 10 aa, Artificial Sequence
  Artificially Synthesized Peptide
FPLCSLYLIA

SEQ ID NO: 396 - protein, 10 aa, Artificial Sequence
  Artificially Synthesized Peptide
EPMYIFLCML

SEQ ID NO: 397 - protein, 10 aa, Artificial Sequence
  Artificially Synthesized Peptide
TTIQFDACLL

SEQ ID NO: 398 - protein, 10 aa, Artificial Sequence
  Artificially Synthesized Peptide
SMPKMLAIFW

SEQ ID NO: 399 - protein, 10 aa, Artificial Sequence
  Artificially Synthesized Peptide
RLFHVATHAS

SEQ ID NO: 400 - protein, 10 aa, Artificial Sequence
  Artificially Synthesized Peptide
LSGMESTVLL

SEQ ID NO: 401 - protein, 9 aa, Artificial Sequence
  Artificially Synthesized Peptide
GLTREAQAK

SEQ ID NO: 402 - protein, 9 aa, Artificial Sequence
  Artificially Synthesized Peptide
VLTLPRVTK

SEQ ID NO: 403 - protein, 9 aa, Artificial Sequence
  Artificially Synthesized Peptide
SLHEPMYIF

SEQ ID NO: 404 - protein, 9 aa, Artificial Sequence
  Artificially Synthesized Peptide
SMVHRFSKR

SEQ ID NO: 405 - protein, 9 aa, Artificial Sequence
  Artificially Synthesized Peptide
GLDSLLISF

SEQ ID NO: 406 - protein, 9 aa, Artificial Sequence
  Artificially Synthesized Peptide
VLLAMAFDR

SEQ ID NO: 407 - protein, 9 aa, Artificial Sequence
  Artificially Synthesized Peptide
NLTIIYIVR

SEQ ID NO: 408 - protein, 9 aa, Artificial Sequence
  Artificially Synthesized Peptide
LLAMAFDRY

SEQ ID NO: 409 - protein, 9 aa, Artificial Sequence
  Artificially Synthesized Peptide
GLEEAQFWL

SEQ ID NO: 410 - protein, 9 aa, Artificial Sequence
  Artificially Synthesized Peptide
LLISFSYLL

SEQ ID NO: 411 - protein, 9 aa, Artificial Sequence
  Artificially Synthesized Peptide
VLGNLTIIY

SEQ ID NO: 412 - protein, 9 aa, Artificial Sequence
  Artificially Synthesized Peptide
ALMAPLPVF

SEQ ID NO: 413 - protein, 9 aa, Artificial Sequence
  Artificially Synthesized Peptide
GLIVIISAI

SEQ ID NO: 414 - protein, 9 aa, Artificial Sequence
  Artificially Synthesized Peptide
VLNPIVYGV

SEQ ID NO: 415 - protein, 9 aa, Artificial Sequence
  Artificially Synthesized Peptide
LISTSSMPK

SEQ ID NO: 416 - protein, 9 aa, Artificial Sequence
  Artificially Synthesized Peptide
CLHQDVMKL

SEQ ID NO: 417 - protein, 9 aa, Artificial Sequence
  Artificially Synthesized Peptide
HVCAVFIFY

SEQ ID NO: 418 - protein, 9 aa, Artificial Sequence
  Artificially Synthesized Peptide
GMESTVLLA

SEQ ID NO: 419 - protein, 9 aa, Artificial Sequence
  Artificially Synthesized Peptide
SMPKMLAIF

SEQ ID NO: 420 - protein, 9 aa, Artificial Sequence
  Artificially Synthesized Peptide
AVFIFYVPF

SEQ ID NO: 421 - protein, 9 aa, Artificial Sequence
  Artificially Synthesized Peptide
MAPLPVFIK

SEQ ID NO: 422 - protein, 9 aa, Artificial Sequence
  Artificially Synthesized Peptide
SLLISFSYL

SEQ ID NO: 423 - protein, 9 aa, Artificial Sequence
  Artificially Synthesized Peptide
MLSGIDILI

SEQ ID NO: 424 - protein, 9 aa, Artificial Sequence
  Artificially Synthesized Peptide
RLFHVATHA

SEQ ID NO: 425 - protein, 9 aa, Artificial Sequence
  Artificially Synthesized Peptide
PMYIFLCML

SEQ ID NO: 426 - protein, 9 aa, Artificial Sequence
  Artificially Synthesized Peptide
WLAFPLCSL

SEQ ID NO: 427 - protein, 9 aa, Artificial Sequence
  Artificially Synthesized Peptide
CLLQIFAIH

SEQ ID NO: 428 - protein, 9 aa, Artificial Sequence
  Artificially Synthesized Peptide
CMLSGIDIL

SEQ ID NO: 429 - protein, 9 aa, Artificial Sequence
  Artificially Synthesized Peptide
KMLAIFWFN

SEQ ID NO: 430 - protein, 9 aa, Artificial Sequence
  Artificially Synthesized Peptide
KIGVAAVVR

SEQ ID NO: 431 - protein, 9 aa, Artificial Sequence
  Artificially Synthesized Peptide
KLACDDIRV

SEQ ID NO: 432 - protein, 9 aa, Artificial Sequence
  Artificially Synthesized Peptide
FIKQLPFCR

SEQ ID NO: 433 - protein, 9 aa, Artificial Sequence
  Artificially Synthesized Peptide
YLLILKTVL

SEQ ID NO: 434 - protein, 9 aa, Artificial Sequence
  Artificially Synthesized Peptide
LMAPLPVFI

SEQ ID NO: 435 - protein, 9 aa, Artificial Sequence
  Artificially Synthesized Peptide
ATYFILIGL

SEQ ID NO: 436 - protein, 9 aa, Artificial Sequence
  Artificially Synthesized Peptide
VVYGLIVII

SEQ ID NO: 437 - protein, 9 aa, Artificial Sequence
  Artificially Synthesized Peptide
YLIAVLGNL

SEQ ID NO: 438 - protein, 9 aa, Artificial Sequence
  Artificially Synthesized Peptide
QLPFCRSNI

SEQ ID NO: 439 - protein, 9 aa, Artificial Sequence
  Artificially Synthesized Peptide
FIGLSMVHR

SEQ ID NO: 440 - protein, 9 aa, Artificial Sequence
  Artificially Synthesized Peptide
ILANIYLLV

SEQ ID NO: 441 - protein, 9 aa, Artificial Sequence
  Artificially Synthesized Peptide
AMAFDRYVA

SEQ ID NO: 442 - protein, 9 aa, Artificial Sequence
  Artificially Synthesized Peptide
VMKLACDDI

SEQ ID NO: 443 - protein, 9 aa, Artificial Sequence
  Artificially Synthesized Peptide
MVHRFSKRR

SEQ ID NO: 444 - protein, 9 aa, Artificial Sequence
  Artificially Synthesized Peptide
LILKTVLGL

SEQ ID NO: 445 - protein, 9 aa, Artificial Sequence
  Artificially Synthesized Peptide
LSMVHRFSK

SEQ ID NO: 446 - protein, 9 aa, Artificial Sequence
  Artificially Synthesized Peptide
PIVYGVKTK

SEQ ID NO: 447 - protein, 9 aa, Artificial Sequence
  Artificially Synthesized Peptide
LLVPPVLNP

SEQ ID NO: 448 - protein, 9 aa, Artificial Sequence
  Artificially Synthesized Peptide
VILANIYLL

SEQ ID NO: 449 - protein, 9 aa, Artificial Sequence
  Artificially Synthesized Peptide
YVAICHPLR

SEQ ID NO: 450 - protein, 9 aa, Artificial Sequence
  Artificially Synthesized Peptide
MLAIFWFNS

SEQ ID NO: 451 - protein, 9 aa, Artificial Sequence
  Artificially Synthesized Peptide
ILRLFHVAT

SEQ ID NO: 452 - protein, 9 aa, Artificial Sequence
  Artificially Synthesized Peptide
LAFPLCSLY

SEQ ID NO: 453 - protein, 9 aa, Artificial Sequence
  Artificially Synthesized Peptide
YCLHQDVMK

SEQ ID NO: 454 - protein, 9 aa, Artificial Sequence
  Artificially Synthesized Peptide
SLSGMESTV

SEQ ID NO: 455 - protein, 9 aa, Artificial Sequence
  Artificially Synthesized Peptide
CVSHVCAVF

SEQ ID NO: 456 - protein, 9 aa, Artificial Sequence
  Artificially Synthesized Peptide
NIYLLVPPV

SEQ ID NO: 457 - protein, 9 aa, Artificial Sequence
  Artificially Synthesized Peptide
STVLLAMAF

SEQ ID NO: 458 - protein, 9 aa, Artificial Sequence
  Artificially Synthesized Peptide
NILSHSYCL

SEQ ID NO: 459 - protein, 9 aa, Artificial Sequence
  Artificially Synthesized Peptide
AQFWLAFPL

SEQ ID NO: 460 - protein, 9 aa, Artificial Sequence
  Artificially Synthesized Peptide
NVVYGLIVI

SEQ ID NO: 461 - protein, 9 aa, Artificial Sequence
  Artificially Synthesized Peptide
LLQIFAIHS

SEQ ID NO: 462 - protein, 9 aa, Artificial Sequence
  Artificially Synthesized Peptide
KTKEIRQRI

SEQ ID NO: 463 - protein, 9 aa, Artificial Sequence
  Artificially Synthesized Peptide
LTLPRVTKI

SEQ ID NO: 464 - protein, 9 aa, Artificial Sequence
  Artificially Synthesized Peptide
AVLGNLTII

SEQ ID NO: 465 - protein, 9 aa, Artificial Sequence
  Artificially Synthesized Peptide
LVPPVLNPI

SEQ ID NO: 466 - protein, 9 aa, Artificial Sequence
  Artificially Synthesized Peptide
ILSHSYCLH

SEQ ID NO: 467 - protein, 9 aa, Artificial Sequence
  Artificially Synthesized Peptide
PVFIKQLPF

SEQ ID NO: 468 - protein, 9 aa, Artificial Sequence
  Artificially Synthesized Peptide
IVIISAIGL

SEQ ID NO: 469 - protein, 9 aa, Artificial Sequence
  Artificially Synthesized Peptide
AIFWFNSTT

SEQ ID NO: 470 - protein, 9 aa, Artificial Sequence
  Artificially Synthesized Peptide
SLYLIAVLG

SEQ ID NO: 471 - protein, 9 aa, Artificial Sequence
  Artificially Synthesized Peptide
IIYIVRTEH

SEQ ID NO: 472 - protein, 9 aa, Artificial Sequence
  Artificially Synthesized Peptide
FILIGLPGL

SEQ ID NO: 473 - protein, 9 aa, Artificial Sequence
  Artificially Synthesized Peptide
TTIQFDACL

SEQ ID NO: 474 - protein, 9 aa, Artificial Sequence
  Artificially Synthesized Peptide
PLPVILANI

SEQ ID NO: 475 - protein, 9 aa, Artificial Sequence
  Artificially Synthesized Peptide
ISFSYLLIL

SEQ ID NO: 476 - protein, 9 aa, Artificial Sequence
  Artificially Synthesized Peptide
PLPVFIKQL

SEQ ID NO: 477 - protein, 9 aa, Artificial Sequence
  Artificially Synthesized Peptide
AIGLDSLLI

SEQ ID NO: 478 - protein, 9 aa, Artificial Sequence
  Artificially Synthesized Peptide
LISFSYLLI

SEQ ID NO: 479 - protein, 9 aa, Artificial Sequence
  Artificially Synthesized Peptide
KEIRQRILR

SEQ ID NO: 480 - protein, 9 aa, Artificial Sequence
  Artificially Synthesized Peptide
GLPGLEEAQ

SEQ ID NO: 481 - protein, 9 aa, Artificial Sequence
  Artificially Synthesized Peptide
YIVRTEHSL

SEQ ID NO: 482 - protein, 9 aa, Artificial Sequence
  Artificially Synthesized Peptide
RILRLFHVA

SEQ ID NO: 483 - protein, 9 aa, Artificial Sequence
  Artificially Synthesized Peptide
HATVLTLPR

SEQ ID NO: 484 - protein, 9 aa, Artificial Sequence
  Artificially Synthesized Peptide
ILKTVLGLT

SEQ ID NO: 485 - protein, 9 aa, Artificial Sequence
  Artificially Synthesized Peptide
SFSYLLILK

SEQ ID NO: 486 - protein, 9 aa, Artificial Sequence
  Artificially Synthesized Peptide
YVPFIGLSM

SEQ ID NO: 487 - protein, 9 aa, Artificial Sequence
  Artificially Synthesized Peptide
LPVILANIY

SEQ ID NO: 488 - protein, 9 aa, Artificial Sequence
  Artificially Synthesized Peptide
TIQFDACLL

SEQ ID NO: 489 - protein, 9 aa, Artificial Sequence
  Artificially Synthesized Peptide
VVRGAALMA

SEQ ID NO: 490 - protein, 9 aa, Artificial Sequence
  Artificially Synthesized Peptide
SSATYFILI

SEQ ID NO: 491 - protein, 9 aa, Artificial Sequence
  Artificially Synthesized Peptide
EIRQRILRL

SEQ ID NO: 492 - protein, 9 aa, Artificial Sequence
  Artificially Synthesized Peptide
KAFGTCVSH

SEQ ID NO: 493 - protein, 9 aa, Artificial Sequence
  Artificially Synthesized Peptide
YLLVPPVLN

SEQ ID NO: 494 - protein, 9 aa, Artificial Sequence
  Artificially Synthesized Peptide
FIFYVPFIG

SEQ ID NO: 495 - protein, 9 aa, Artificial Sequence
  Artificially Synthesized Peptide
ACLLQIFAI

SEQ ID NO: 496 - protein, 9 aa, Artificial Sequence
  Artificially Synthesized Peptide
DSLLISFSY

SEQ ID NO: 497 - protein, 9 aa, Artificial Sequence
  Artificially Synthesized Peptide
FPLCSLYLI

SEQ ID NO: 498 - protein, 9 aa, Artificial Sequence
  Artificially Synthesized Peptide
LQIFAIHSL

SEQ ID NO: 499 - protein, 9 aa, Artificial Sequence
  Artificially Synthesized Peptide
PLCSLYLIA

SEQ ID NO: 500 - protein, 9 aa, Artificial Sequence
  Artificially Synthesized Peptide
LTIIYIVRT

SEQ ID NO: 501 - protein, 10 aa, Artificial Sequence
  Artificially Synthesized Peptide
LMAPLPVFIK

SEQ ID NO: 502 - protein, 10 aa, Artificial Sequence
  Artificially Synthesized Peptide
GLSMVHRFSK

SEQ ID NO: 503 - protein, 10 aa, Artificial Sequence
  Artificially Synthesized Peptide
ILISTSSMPK

SEQ ID NO: 504 - protein, 10 aa, Artificial Sequence
  Artificially Synthesized Peptide
VLLAMAFDRY

SEQ ID NO: 505 - protein, 10 aa, Artificial Sequence
  Artificially Synthesized Peptide
VLNPIVYGVK

SEQ ID NO: 506 - protein, 10 aa, Artificial Sequence
  Artificially Synthesized Peptide
GLPGLEEAQF

SEQ ID NO: 507 - protein, 10 aa, Artificial Sequence
  Artificially Synthesized Peptide
SMVHRFSKRR

SEQ ID NO: 508 - protein, 10 aa, Artificial Sequence
  Artificially Synthesized Peptide
SLLISFSYLL

SEQ ID NO: 509 - protein, 10 aa, Artificial Sequence
  Artificially Synthesized Peptide
GLEEAQFWLA

SEQ ID NO: 510 - protein, 10 aa, Artificial Sequence
  Artificially Synthesized Peptide
ILKTVLGLTR

SEQ ID NO: 511 - protein, 10 aa, Artificial Sequence
  Artificially Synthesized Peptide
LLILKTVLGL

SEQ ID NO: 512 - protein, 10 aa, Artificial Sequence
  Artificially Synthesized Peptide
TVLTLPRVTK

SEQ ID NO: 513 - protein, 10 aa, Artificial Sequence
  Artificially Synthesized Peptide
WLAFPLCSLY

SEQ ID NO: 514 - protein, 10 aa, Artificial Sequence
  Artificially Synthesized Peptide
VMKLACDDIR

SEQ ID NO: 515 - protein, 10 aa, Artificial Sequence
  Artificially Synthesized Peptide
LLVPPVLNPI

SEQ ID NO: 516 - protein, 10 aa, Artificial Sequence
  Artificially Synthesized Peptide
CMLSGIDILI

SEQ ID NO: 517 - protein, 10 aa, Artificial Sequence
  Artificially Synthesized Peptide
AVFIFYVPFI

SEQ ID NO: 518 - protein, 10 aa, Artificial Sequence
  Artificially Synthesized Peptide
GMESTVLLAM

SEQ ID NO: 519 - protein, 10 aa, Artificial Sequence
  Artificially Synthesized Peptide
FIFYVPFIGL

SEQ ID NO: 520 - protein, 10 aa, Artificial Sequence
  Artificially Synthesized Peptide
TVLLAMAFDR

SEQ ID NO: 521 - protein, 10 aa, Artificial Sequence
  Artificially Synthesized Peptide
VLTLPRVTKI

SEQ ID NO: 522 - protein, 10 aa, Artificial Sequence
  Artificially Synthesized Peptide
AVLGNLTIIY

SEQ ID NO: 523 - protein, 10 aa, Artificial Sequence
  Artificially Synthesized Peptide
SLHEPMYIFL

SEQ ID NO: 524 - protein, 10 aa, Artificial Sequence
  Artificially Synthesized Peptide
LLISFSYLLI

SEQ ID NO: 525 - protein, 10 aa, Artificial Sequence
  Artificially Synthesized Peptide
VLGNLTIIYI

SEQ ID NO: 526 - protein, 10 aa, Artificial Sequence
  Artificially Synthesized Peptide
KMLAIFWFNS

SEQ ID NO: 527 - protein, 10 aa, Artificial Sequence
  Artificially Synthesized Peptide
ISFSYLLILK

SEQ ID NO: 528 - protein, 10 aa, Artificial Sequence
  Artificially Synthesized Peptide
FLCMLSGIDI

SEQ ID NO: 529 - protein, 10 aa, Artificial Sequence
  Artificially Synthesized Peptide
LLQIFAIHSL

SEQ ID NO: 530 - protein, 10 aa, Artificial Sequence
  Artificially Synthesized Peptide
SLSGMESTVL

SEQ ID NO: 531 - protein, 10 aa, Artificial Sequence
  Artificially Synthesized Peptide
ALMAPLPVFI

SEQ ID NO: 532 - protein, 10 aa, Artificial Sequence
  Artificially Synthesized Peptide
MLAIFWFNST

SEQ ID NO: 533 - protein, 10 aa, Artificial Sequence
  Artificially Synthesized Peptide
FIGLSMVHRF

SEQ ID NO: 534 - protein, 10 aa, Artificial Sequence
  Artificially Synthesized Peptide
ILRLFHVATH

SEQ ID NO: 535 - protein, 10 aa, Artificial Sequence
  Artificially Synthesized Peptide
AMAFDRYVAI

SEQ ID NO: 536 - protein, 10 aa, Artificial Sequence
  Artificially Synthesized Peptide
QLPFCRSNIL

SEQ ID NO: 537 - protein, 10 aa, Artificial Sequence
  Artificially Synthesized Peptide
SLYLIAVLGN

SEQ ID NO: 538 - protein, 10 aa, Artificial Sequence
  Artificially Synthesized Peptide
GLTREAQAKA

SEQ ID NO: 539 - protein, 10 aa, Artificial Sequence
  Artificially Synthesized Peptide
LISFSYLLIL

SEQ ID NO: 540 - protein, 10 aa, Artificial Sequence
  Artificially Synthesized Peptide
NLTIIYIVRT

SEQ ID NO: 541 - protein, 10 aa, Artificial Sequence
  Artificially Synthesized Peptide
NIYLLVPPVL

SEQ ID NO: 542 - protein, 10 aa, Artificial Sequence
  Artificially Synthesized Peptide
YIFLCMLSGI

SEQ ID NO: 543 - protein, 10 aa, Artificial Sequence
  Artificially Synthesized Peptide
NPIVYGVKTK

SEQ ID NO: 544 - protein, 10 aa, Artificial Sequence
  Artificially Synthesized Peptide
TLPRVTKIGV

SEQ ID NO: 545 - protein, 10 aa, Artificial Sequence
  Artificially Synthesized Peptide
SMPKMLAIFW

SEQ ID NO: 546 - protein, 10 aa, Artificial Sequence
  Artificially Synthesized Peptide
PLPVILANIY

SEQ ID NO: 547 - protein, 10 aa, Artificial Sequence
  Artificially Synthesized Peptide
PLRHATVLTL

SEQ ID NO: 548 - protein, 10 aa, Artificial Sequence
  Artificially Synthesized Peptide
CLLQIFAIHS

SEQ ID NO: 549 - protein, 10 aa, Artificial Sequence
  Artificially Synthesized Peptide
AIFWFNSTTI

SEQ ID NO: 550 - protein, 10 aa, Artificial Sequence
  Artificially Synthesized Peptide
IQFDACLLQI

SEQ ID NO: 551 - protein, 10 aa, Artificial Sequence
  Artificially Synthesized Peptide
YLLVPPVLNP

SEQ ID NO: 552 - protein, 10 aa, Artificial Sequence
  Artificially Synthesized Peptide
VVYGLIVIIS

SEQ ID NO: 553 - protein, 10 aa, Artificial Sequence
  Artificially Synthesized Peptide
HVCAVFIFYV

SEQ ID NO: 554 - protein, 10 aa, Artificial Sequence
  Artificially Synthesized Peptide
DIRVNVVYGL

SEQ ID NO: 555 - protein, 10 aa, Artificial Sequence
  Artificially Synthesized Peptide
CLHQDVMKLA

SEQ ID NO: 556 - protein, 10 aa, Artificial Sequence
  Artificially Synthesized Peptide
IVYGVKTKEI

SEQ ID NO: 557 - protein, 10 aa, Artificial Sequence
  Artificially Synthesized Peptide
RLFHVATHAS

SEQ ID NO: 558 - protein, 10 aa, Artificial Sequence
  Artificially Synthesized Peptide
VLGLTREAQA

SEQ ID NO: 559 - protein, 10 aa, Artificial Sequence
  Artificially Synthesized Peptide
PLCSLYLIAV

SEQ ID NO: 560 - protein, 10 aa, Artificial Sequence
  Artificially Synthesized Peptide
GVKTKEIRQR

SEQ ID NO: 561 - protein, 10 aa, Artificial Sequence
  Artificially Synthesized Peptide
GLDSLLISFS

SEQ ID NO: 562 - protein, 10 aa, Artificial Sequence
  Artificially Synthesized Peptide
LIVIISAIGL

SEQ ID NO: 563 - protein, 10 aa, Artificial Sequence
  Artificially Synthesized Peptide
MLSGIDILIS

SEQ ID NO: 564 - protein, 10 aa, Artificial Sequence
  Artificially Synthesized Peptide
ILANIYLLVP

SEQ ID NO: 565 - protein, 10 aa, Artificial Sequence
  Artificially Synthesized Peptide
YLIAVLGNLT

SEQ ID NO: 566 - protein, 10 aa, Artificial Sequence
  Artificially Synthesized Peptide
ILIGLPGLEE

SEQ ID NO: 567 - protein, 10 aa, Artificial Sequence
  Artificially Synthesized Peptide
NVVYGLIVII

SEQ ID NO: 568 - protein, 10 aa, Artificial Sequence
  Artificially Synthesized Peptide
KAFGTCVSHV

SEQ ID NO: 569 - protein, 10 aa, Artificial Sequence
  Artificially Synthesized Peptide
GLIVIISAIG

SEQ ID NO: 570 - protein, 10 aa, Artificial Sequence
  Artificially Synthesized Peptide
KQLPFCRSNI

SEQ ID NO: 571 - protein, 10 aa, Artificial Sequence
  Artificially Synthesized Peptide
ILSHSYCLHQ

SEQ ID NO: 572 - protein, 10 aa, Artificial Sequence
  Artificially Synthesized Peptide
RVNVVYGLIV

SEQ ID NO: 573 - protein, 10 aa, Artificial Sequence
  Artificially Synthesized Peptide
LIAVLGNLTI

SEQ ID NO: 574 - protein, 10 aa, Artificial Sequence
  Artificially Synthesized Peptide
GNLTIIYIVR

SEQ ID NO: 575 - protein, 10 aa, Artificial Sequence
  Artificially Synthesized Peptide
HSLHEPMYIF

SEQ ID NO: 576 - protein, 10 aa, Artificial Sequence
  Artificially Synthesized Peptide
AQFWLAFPLC

SEQ ID NO: 577 - protein, 10 aa, Artificial Sequence
  Artificially Synthesized Peptide
GTCVSHVCAV

SEQ ID NO: 578 - protein, 10 aa, Artificial Sequence
  Artificially Synthesized Peptide
LAFPLCSLYL

SEQ ID NO: 579 - protein, 10 aa, Artificial Sequence
  Artificially Synthesized Peptide
LSMVHRFSKR

SEQ ID NO: 580 - protein, 10 aa, Artificial Sequence
  Artificially Synthesized Peptide
VILANIYLLV

SEQ ID NO: 581 - protein, 10 aa, Artificial Sequence
  Artificially Synthesized Peptide
MAFDRYVAIC

SEQ ID NO: 582 - protein, 10 aa, Artificial Sequence
  Artificially Synthesized Peptide
VSHVCAVFIF

SEQ ID NO: 583 - protein, 10 aa, Artificial Sequence
  Artificially Synthesized Peptide
STTIQFDACL

SEQ ID NO: 584 - protein, 10 aa, Artificial Sequence
  Artificially Synthesized Peptide
CAVFIFYVPF

SEQ ID NO: 585 - protein, 10 aa, Artificial Sequence
  Artificially Synthesized Peptide
IISAIGLDSL

SEQ ID NO: 586 - protein, 10 aa, Artificial Sequence
  Artificially Synthesized Peptide
MPKMLAIFWF

SEQ ID NO: 587 - protein, 10 aa, Artificial Sequence
  Artificially Synthesized Peptide
VPPVLNPIVY

SEQ ID NO: 588 - protein, 10 aa, Artificial Sequence
  Artificially Synthesized Peptide
LTREAQAKAF

SEQ ID NO: 589 - protein, 10 aa, Artificial Sequence
  Artificially Synthesized Peptide
AALMAPLPVF

SEQ ID NO: 590 - protein, 10 aa, Artificial Sequence
  Artificially Synthesized Peptide
CVSHVCAVFI

SEQ ID NO: 591 - protein, 10 aa, Artificial Sequence
  Artificially Synthesized Peptide
LPVFIKQLPF

SEQ ID NO: 592 - protein, 10 aa, Artificial Sequence
  Artificially Synthesized Peptide
LLAMAFDRYV

SEQ ID NO: 593 - protein, 10 aa, Artificial Sequence
  Artificially Synthesized Peptide
AVVRGAALMA

SEQ ID NO: 594 - protein, 10 aa, Artificial Sequence
  Artificially Synthesized Peptide
RVTKIGVAAV

SEQ ID NO: 595 - protein, 10 aa, Artificial Sequence
  Artificially Synthesized Peptide
SHVCAVFIFY

SEQ ID NO: 596 - protein, 10 aa, Artificial Sequence
  Artificially Synthesized Peptide
YCLHQDVMKL

SEQ ID NO: 597 - protein, 10 aa, Artificial Sequence
  Artificially Synthesized Peptide
TIIYIVRTEH

SEQ ID NO: 598 - protein, 10 aa, Artificial Sequence
  Artificially Synthesized Peptide
TCVSHVCAVF

SEQ ID NO: 599 - protein, 10 aa, Artificial Sequence
  Artificially Synthesized Peptide
TTIQFDACLL

SEQ ID NO: 600 - protein, 10 aa, Artificial Sequence
  Artificially Synthesized Peptide
RILRLFHVAT

SEQ ID NO: 601 - protein, 9 aa, Artificial Sequence
  Artificially Synthesized Peptide
GLTREAQAK

SEQ ID NO: 602 - protein, 9 aa, Artificial Sequence
  Artificially Synthesized Peptide
LISTSSMPK

SEQ ID NO: 603 - protein, 9 aa, Artificial Sequence
  Artificially Synthesized Peptide
MAPLPVFIK

SEQ ID NO: 604 - protein, 9 aa, Artificial Sequence
  Artificially Synthesized Peptide
SFSYLLILK

SEQ ID NO: 605 - protein, 9 aa, Artificial Sequence
  Artificially Synthesized Peptide
YVAICHPLR

SEQ ID NO: 606 - protein, 9 aa, Artificial Sequence
  Artificially Synthesized Peptide
VLTLPRVTK

SEQ ID NO: 607 - protein, 9 aa, Artificial Sequence
  Artificially Synthesized Peptide
VLLAMAFDR

SEQ ID NO: 608 - protein, 9 aa, Artificial Sequence
  Artificially Synthesized Peptide
YCLHQDVMK

SEQ ID NO: 609 - protein, 9 aa, Artificial Sequence
  Artificially Synthesized Peptide
KIGVAAVVR

SEQ ID NO: 610 - protein, 9 aa, Artificial Sequence
  Artificially Synthesized Peptide
FIKQLPFCR

SEQ ID NO: 611 - protein, 9 aa, Artificial Sequence
  Artificially Synthesized Peptide
MVHRFSKRR

SEQ ID NO: 612 - protein, 9 aa, Artificial Sequence
  Artificially Synthesized Peptide
NLTIIYIVR

SEQ ID NO: 613 - protein, 9 aa, Artificial Sequence
  Artificially Synthesized Peptide
LSMVHRFSK

SEQ ID NO: 614 - protein, 9 aa, Artificial Sequence
  Artificially Synthesized Peptide
SMVHRFSKR

SEQ ID NO: 615 - protein, 9 aa, Artificial Sequence
  Artificially Synthesized Peptide
KEIRQRILR

SEQ ID NO: 616 - protein, 9 aa, Artificial Sequence
  Artificially Synthesized Peptide
FIGLSMVHR

SEQ ID NO: 617 - protein, 9 aa, Artificial Sequence
  Artificially Synthesized Peptide
HATVLTLPR

SEQ ID NO: 618 - protein, 9 aa, Artificial Sequence
  Artificially Synthesized Peptide
RVTKIGVAA

SEQ ID NO: 619 - protein, 9 aa, Artificial Sequence
  Artificially Synthesized Peptide
NVVYGLIVI

SEQ ID NO: 620 - protein, 9 aa, Artificial Sequence
  Artificially Synthesized Peptide
IVIISAIGL

SEQ ID NO: 621 - protein, 9 aa, Artificial Sequence
  Artificially Synthesized Peptide
RVNVVYGLI

SEQ ID NO: 622 - protein, 9 aa, Artificial Sequence
  Artificially Synthesized Peptide
VVRGAALMA

SEQ ID NO: 623 - protein, 9 aa, Artificial Sequence
  Artificially Synthesized Peptide
HVCAVFIFY

SEQ ID NO: 624 - protein, 9 aa, Artificial Sequence
  Artificially Synthesized Peptide
ATYFILIGL

SEQ ID NO: 625 - protein, 9 aa, Artificial Sequence
  Artificially Synthesized Peptide
VVYGLIVII

SEQ ID NO: 626 - protein, 9 aa, Artificial Sequence
  Artificially Synthesized Peptide
AVFIFYVPF

SEQ ID NO: 627 - protein, 9 aa, Artificial Sequence
  Artificially Synthesized Peptide
LNPIVYGVK

SEQ ID NO: 628 - protein, 9 aa, Artificial Sequence
  Artificially Synthesized Peptide
YVPFIGLSM

SEQ ID NO: 629 - protein, 9 aa, Artificial Sequence
  Artificially Synthesized Peptide
RQRILRLFH

SEQ ID NO: 630 - protein, 9 aa, Artificial Sequence
  Artificially Synthesized Peptide
GLEEAQFWL

SEQ ID NO: 631 - protein, 9 aa, Artificial Sequence
  Artificially Synthesized Peptide
AQFWLAFPL

SEQ ID NO: 632 - protein, 9 aa, Artificial Sequence
  Artificially Synthesized Peptide
PIVYGVKTK

SEQ ID NO: 633 - protein, 9 aa, Artificial Sequence
  Artificially Synthesized Peptide
GTCVSHVCA

SEQ ID NO: 634 - protein, 9 aa, Artificial Sequence
  Artificially Synthesized Peptide
KTKEIRQRI

SEQ ID NO: 635 - protein, 9 aa, Artificial Sequence
  Artificially Synthesized Peptide
AVLGNLTII

SEQ ID NO: 636 - protein, 9 aa, Artificial Sequence
  Artificially Synthesized Peptide
AVVRGAALM

SEQ ID NO: 637 - protein, 9 aa, Artificial Sequence
  Artificially Synthesized Peptide
STVLLAMAF

SEQ ID NO: 638 - protein, 9 aa, Artificial Sequence
  Artificially Synthesized Peptide
RLFHVATHA

SEQ ID NO: 639 - protein, 9 aa, Artificial Sequence
  Artificially Synthesized Peptide
KLACDDIRV

SEQ ID NO: 640 - protein, 9 aa, Artificial Sequence
  Artificially Synthesized Peptide
GLDSLLISF

SEQ ID NO: 641 - protein, 9 aa, Artificial Sequence
  Artificially Synthesized Peptide
GMESTVLLA

SEQ ID NO: 642 - protein, 9 aa, Artificial Sequence
  Artificially Synthesized Peptide
IVRTEHSLH

SEQ ID NO: 643 - protein, 9 aa, Artificial Sequence
  Artificially Synthesized Peptide
CVSHVCAVF

SEQ ID NO: 644 - protein, 9 aa, Artificial Sequence
  Artificially Synthesized Peptide
LVPPVLNPI

SEQ ID NO: 645 - protein, 9 aa, Artificial Sequence
  Artificially Synthesized Peptide
RILRLFHVA

SEQ ID NO: 646 - protein, 9 aa, Artificial Sequence
  Artificially Synthesized Peptide
RYVAICHPL

SEQ ID NO: 647 - protein, 9 aa, Artificial Sequence
  Artificially Synthesized Peptide
GLIVIISAI

SEQ ID NO: 648 - protein, 9 aa, Artificial Sequence
  Artificially Synthesized Peptide
TTIQFDACL

SEQ ID NO: 649 - protein, 9 aa, Artificial Sequence
  Artificially Synthesized Peptide
ATVLTLPRV

SEQ ID NO: 650 - protein, 9 aa, Artificial Sequence
  Artificially Synthesized Peptide
LTLPRVTKI

SEQ ID NO: 651 - protein, 9 aa, Artificial Sequence
  Artificially Synthesized Peptide
KAFGTCVSH

SEQ ID NO: 652 - protein, 9 aa, Artificial Sequence
  Artificially Synthesized Peptide
NILSHSYCL

SEQ ID NO: 653 - protein, 9 aa, Artificial Sequence
  Artificially Synthesized Peptide
LLISFSYLL

SEQ ID NO: 654 - protein, 9 aa, Artificial Sequence
  Artificially Synthesized Peptide
VILANIYLL

SEQ ID NO: 655 - protein, 9 aa, Artificial Sequence
  Artificially Synthesized Peptide
LILKTVLGL

SEQ ID NO: 656 - protein, 9 aa, Artificial Sequence
  Artificially Synthesized Peptide
GVKTKEIRQ

SEQ ID NO: 657 - protein, 9 aa, Artificial Sequence
  Artificially Synthesized Peptide
VTKIGVAAV

SEQ ID NO: 658 - protein, 9 aa, Artificial Sequence
  Artificially Synthesized Peptide
LTREAQAKA

SEQ ID NO: 659 - protein, 9 aa, Artificial Sequence
  Artificially Synthesized Peptide
LQIFAIHSL

SEQ ID NO: 660 - protein, 9 aa, Artificial Sequence
  Artificially Synthesized Peptide
ACLLQIFAI

SEQ ID NO: 661 - protein, 9 aa, Artificial Sequence
  Artificially Synthesized Peptide
IIYIVRTEH

SEQ ID NO: 662 - protein, 9 aa, Artificial Sequence
  Artificially Synthesized Peptide
NIYLLVPPV

SEQ ID NO: 663 - protein, 9 aa, Artificial Sequence
  Artificially Synthesized Peptide
SLHEPMYIF

SEQ ID NO: 664 - protein, 9 aa, Artificial Sequence
  Artificially Synthesized Peptide
LCMLSGIDI

SEQ ID NO: 665 - protein, 9 aa, Artificial Sequence
  Artificially Synthesized Peptide
MLSGIDILI

SEQ ID NO: 666 - protein, 9 aa, Artificial Sequence
  Artificially Synthesized Peptide
AIGLDSLLI

SEQ ID NO: 667 - protein, 9 aa, Artificial Sequence
  Artificially Synthesized Peptide
LKTVLGLTR

SEQ ID NO: 668 - protein, 9 aa, Artificial Sequence
  Artificially Synthesized Peptide
CLHQDVMKL

SEQ ID NO: 669 - protein, 9 aa, Artificial Sequence
  Artificially Synthesized Peptide
ILANIYLLV

SEQ ID NO: 670 - protein, 9 aa, Artificial Sequence
  Artificially Synthesized Peptide
VLNPIVYGV

SEQ ID NO: 671 - protein, 9 aa, Artificial Sequence
  Artificially Synthesized Peptide
ALMAPLPVF

SEQ ID NO: 672 - protein, 9 aa, Artificial Sequence
  Artificially Synthesized Peptide
LISFSYLLI

SEQ ID NO: 673 - protein, 9 aa, Artificial Sequence
  Artificially Synthesized Peptide
IFYVPFIGL

SEQ ID NO: 674 - protein, 9 aa, Artificial Sequence
  Artificially Synthesized Peptide
AMAFDRYVA

SEQ ID NO: 675 - protein, 9 aa, Artificial Sequence
  Artificially Synthesized Peptide
VLGNLTIIY

SEQ ID NO: 676 - protein, 9 aa, Artificial Sequence
  Artificially Synthesized Peptide
PVFIKQLPF

SEQ ID NO: 677 - protein, 9 aa, Artificial Sequence
  Artificially Synthesized Peptide
MKLACDDIR

SEQ ID NO: 678 - protein, 9 aa, Artificial Sequence
  Artificially Synthesized Peptide
YGVKTKEIR

SEQ ID NO: 679 - protein, 9 aa, Artificial Sequence
  Artificially Synthesized Peptide
SLLISFSYL

SEQ ID NO: 680 - protein, 9 aa, Artificial Sequence
  Artificially Synthesized Peptide
GVAAVVRGA

SEQ ID NO: 681 - protein, 9 aa, Artificial Sequence
  Artificially Synthesized Peptide
IAVLGNLTI

SEQ ID NO: 682 - protein, 9 aa, Artificial Sequence
  Artificially Synthesized Peptide
YLLILKTVL

SEQ ID NO: 683 - protein, 9 aa, Artificial Sequence
  Artificially Synthesized Peptide
AALMAPLPV

SEQ ID NO: 684 - protein, 9 aa, Artificial Sequence
  Artificially Synthesized Peptide
PVILANIYL

SEQ ID NO: 685 - protein, 9 aa, Artificial Sequence
  Artificially Synthesized Peptide
CMLSGIDIL

SEQ ID NO: 686 - protein, 9 aa, Artificial Sequence
  Artificially Synthesized Peptide
FPLCSLYLI

SEQ ID NO: 687 - protein, 9 aa, Artificial Sequence
  Artificially Synthesized Peptide
VAICHPLRH

SEQ ID NO: 688 - protein, 9 aa, Artificial Sequence
  Artificially Synthesized Peptide
FILIGLPGL

SEQ ID NO: 689 - protein, 9 aa, Artificial Sequence
  Artificially Synthesized Peptide
YLIAVLGNL

SEQ ID NO: 690 - protein, 9 aa, Artificial Sequence
  Artificially Synthesized Peptide
CLLQIFAIH

SEQ ID NO: 691 - protein, 9 aa, Artificial Sequence
  Artificially Synthesized Peptide
IYLLVPPVL

SEQ ID NO: 692 - protein, 9 aa, Artificial Sequence
  Artificially Synthesized Peptide
YIVRTEHSL

SEQ ID NO: 693 - protein, 9 aa, Artificial Sequence
  Artificially Synthesized Peptide
VCAVFIFYV

SEQ ID NO: 694 - protein, 9 aa, Artificial Sequence
  Artificially Synthesized Peptide
STSSMPKML

SEQ ID NO: 695 - protein, 9 aa, Artificial Sequence
  Artificially Synthesized Peptide
KTVLGLTRE

SEQ ID NO: 696 - protein, 9 aa, Artificial Sequence
  Artificially Synthesized Peptide
SYCLHQDVM

SEQ ID NO: 697 - protein, 9 aa, Artificial Sequence
  Artificially Synthesized Peptide
LAFPLCSLY

SEQ ID NO: 698 - protein, 9 aa, Artificial Sequence
  Artificially Synthesized Peptide
QLPFCRSNI

SEQ ID NO: 699 - protein, 9 aa, Artificial Sequence
  Artificially Synthesized Peptide
WLAFPLCSL

SEQ ID NO: 700 - protein, 9 aa, Artificial Sequence
  Artificially Synthesized Peptide
LLAMAFDRY

SEQ ID NO: 701 - protein, 10 aa, Artificial Sequence
  Artificially Synthesized Peptide
GLSMVHRFSK

SEQ ID NO: 702 - protein, 10 aa, Artificial Sequence
  Artificially Synthesized Peptide
TVLTLPRVTK

SEQ ID NO: 703 - protein, 10 aa, Artificial Sequence
  Artificially Synthesized Peptide
TVLLAMAFDR

SEQ ID NO: 704 - protein, 10 aa, Artificial Sequence
  Artificially Synthesized Peptide
LMAPLPVFIK

SEQ ID NO: 705 - protein, 10 aa, Artificial Sequence
  Artificially Synthesized Peptide
ILISTSSMPK

SEQ ID NO: 706 - protein, 10 aa, Artificial Sequence
  Artificially Synthesized Peptide
VLNPIVYGVK

SEQ ID NO: 707 - protein, 10 aa, Artificial Sequence
  Artificially Synthesized Peptide
SYCLHQDVMK

SEQ ID NO: 708 - protein, 10 aa, Artificial Sequence
  Artificially Synthesized Peptide
RYVAICHPLR

SEQ ID NO: 709 - protein, 10 aa, Artificial Sequence
  Artificially Synthesized Peptide
VFIKQLPFCR

SEQ ID NO: 710 - protein, 10 aa, Artificial Sequence
  Artificially Synthesized Peptide
ILKTVLGLTR

SEQ ID NO: 711 - protein, 10 aa, Artificial Sequence
  Artificially Synthesized Peptide
NPIVYGVKTK

SEQ ID NO: 712 - protein, 10 aa, Artificial Sequence
  Artificially Synthesized Peptide
GVKTKEIRQR

SEQ ID NO: 713 - protein, 10 aa, Artificial Sequence
  Artificially Synthesized Peptide
RVNVVYGLIV

SEQ ID NO: 714 - protein, 10 aa, Artificial Sequence
  Artificially Synthesized Peptide
VYGVKTKEIR

SEQ ID NO: 715 - protein, 10 aa, Artificial Sequence
  Artificially Synthesized Peptide
ISFSYLLILK

SEQ ID NO: 716 - protein, 10 aa, Artificial Sequence
  Artificially Synthesized Peptide
VMKLACDDIR

SEQ ID NO: 717 - protein, 10 aa, Artificial Sequence
  Artificially Synthesized Peptide
GNLTIIYIVR

SEQ ID NO: 718 - protein, 10 aa, Artificial Sequence
  Artificially Synthesized Peptide
GVAAVVRGAA

SEQ ID NO: 719 - protein, 10 aa, Artificial Sequence
  Artificially Synthesized Peptide
HVCAVFIFYV

SEQ ID NO: 720 - protein, 10 aa, Artificial Sequence
  Artificially Synthesized Peptide
RVTKIGVAAV

SEQ ID NO: 721 - protein, 10 aa, Artificial Sequence
  Artificially Synthesized Peptide
AVVRGAALMA

SEQ ID NO: 722 - protein, 10 aa, Artificial Sequence
  Artificially Synthesized Peptide
AVLGNLTIIY

SEQ ID NO: 723 - protein, 10 aa, Artificial Sequence
  Artificially Synthesized Peptide
SMVHRFSKRR

SEQ ID NO: 724 - protein, 10 aa, Artificial Sequence
  Artificially Synthesized Peptide
RQRILRLFHV

SEQ ID NO: 725 - protein, 10 aa, Artificial Sequence
  Artificially Synthesized Peptide
AVFIFYVPFI

SEQ ID NO: 726 - protein, 10 aa, Artificial Sequence
  Artificially Synthesized Peptide
YVAICHPLRH

SEQ ID NO: 727 - protein, 10 aa, Artificial Sequence
  Artificially Synthesized Peptide
LGLTREAQAK

SEQ ID NO: 728 - protein, 10 aa, Artificial Sequence
  Artificially Synthesized Peptide
RTEHSLHEPM

SEQ ID NO: 729 - protein, 10 aa, Artificial Sequence
  Artificially Synthesized Peptide
GTCVSHVCAV

SEQ ID NO: 730 - protein, 10 aa, Artificial Sequence
  Artificially Synthesized Peptide
NVVYGLIVII

SEQ ID NO: 731 - protein, 10 aa, Artificial Sequence
  Artificially Synthesized Peptide
KQLPFCRSNI

SEQ ID NO: 732 - protein, 10 aa, Artificial Sequence
  Artificially Synthesized Peptide
RHATVLTLPR

SEQ ID NO: 733 - protein, 10 aa, Artificial Sequence
  Artificially Synthesized Peptide
IQFDACLLQI

SEQ ID NO: 734 - protein, 10 aa, Artificial Sequence
  Artificially Synthesized Peptide
GMESTVLLAM

SEQ ID NO: 735 - protein, 10 aa, Artificial Sequence
  Artificially Synthesized Peptide
GLEEAQFWLA

SEQ ID NO: 736 - protein, 10 aa, Artificial Sequence
  Artificially Synthesized Peptide
IVYGVKTKEI

SEQ ID NO: 737 - protein, 10 aa, Artificial Sequence
  Artificially Synthesized Peptide
CVSHVCAVFI

SEQ ID NO: 738 - protein, 10 aa, Artificial Sequence
  Artificially Synthesized Peptide
YVPFIGLSMV

SEQ ID NO: 739 - protein, 10 aa, Artificial Sequence
  Artificially Synthesized Peptide
STSSMPKMLA

SEQ ID NO: 740 - protein, 10 aa, Artificial Sequence
  Artificially Synthesized Peptide
LVPPVLNPIV

SEQ ID NO: 741 - protein, 10 aa, Artificial Sequence
  Artificially Synthesized Peptide
FIFYVPFIGL

SEQ ID NO: 742 - protein, 10 aa, Artificial Sequence
  Artificially Synthesized Peptide
TTIQFDACLL

SEQ ID NO: 743 - protein, 10 aa, Artificial Sequence
  Artificially Synthesized Peptide
LIVIISAIGL

SEQ ID NO: 744 - protein, 10 aa, Artificial Sequence
  Artificially Synthesized Peptide
VILANIYLLV

SEQ ID NO: 745 - protein, 10 aa, Artificial Sequence
  Artificially Synthesized Peptide
LLILKTVLGL

SEQ ID NO: 746 - protein, 10 aa, Artificial Sequence
  Artificially Synthesized Peptide
GLTREAQAKA

SEQ ID NO: 747 - protein, 10 aa, Artificial Sequence
  Artificially Synthesized Peptide
LLISFSYLLI

SEQ ID NO: 748 - protein, 10 aa, Artificial Sequence
  Artificially Synthesized Peptide
GLPGLEEAQF

SEQ ID NO: 749 - protein, 10 aa, Artificial Sequence
  Artificially Synthesized Peptide
GAALMAPLPV

SEQ ID NO: 750 - protein, 10 aa, Artificial Sequence
  Artificially Synthesized Peptide
CMLSGIDILI

SEQ ID NO: 751 - protein, 10 aa, Artificial Sequence
  Artificially Synthesized Peptide
SLLISFSYLL

SEQ ID NO: 752 - protein, 10 aa, Artificial Sequence
  Artificially Synthesized Peptide
FYVPFIGLSM

SEQ ID NO: 753 - protein, 10 aa, Artificial Sequence
  Artificially Synthesized Peptide
KAFGTCVSHV

SEQ ID NO: 754 - protein, 10 aa, Artificial Sequence
  Artificially Synthesized Peptide
DVMKLACDDI

SEQ ID NO: 755 - protein, 10 aa, Artificial Sequence
  Artificially Synthesized Peptide
STTIQFDACL

SEQ ID NO: 756 - protein, 10 aa, Artificial Sequence
  Artificially Synthesized Peptide
VTKIGVAAVV

SEQ ID NO: 757 - protein, 10 aa, Artificial Sequence
  Artificially Synthesized Peptide
SLHEPMYIFL

SEQ ID NO: 758 - protein, 10 aa, Artificial Sequence
  Artificially Synthesized Peptide
SMPKMLAIFW

SEQ ID NO: 759 - protein, 10 aa, Artificial Sequence
  Artificially Synthesized Peptide
TKEIRQRILR

SEQ ID NO: 760 - protein, 10 aa, Artificial Sequence
  Artificially Synthesized Peptide
VLGNLTIIYI

SEQ ID NO: 761 - protein, 10 aa, Artificial Sequence
  Artificially Synthesized Peptide
LAMAFDRYVA

SEQ ID NO: 762 - protein, 10 aa, Artificial Sequence
  Artificially Synthesized Peptide
YIFLCMLSGI

SEQ ID NO: 763 - protein, 10 aa, Artificial Sequence
  Artificially Synthesized Peptide
LISFSYLLIL

SEQ ID NO: 764 - protein, 10 aa, Artificial Sequence
  Artificially Synthesized Peptide
FLCMLSGIDI

SEQ ID NO: 765 - protein, 10 aa, Artificial Sequence
  Artificially Synthesized Peptide
VYGLIVIISA

SEQ ID NO: 766 - protein, 10 aa, Artificial Sequence
  Artificially Synthesized Peptide
ALMAPLPVFI

SEQ ID NO: 767 - protein, 10 aa, Artificial Sequence
  Artificially Synthesized Peptide
TLPRVTKIGV

SEQ ID NO: 768 - protein, 10 aa, Artificial Sequence
  Artificially Synthesized Peptide
AIFWFNSTTI

SEQ ID NO: 769 - protein, 10 aa, Artificial Sequence
  Artificially Synthesized Peptide
LIAVLGNLTI

SEQ ID NO: 770 - protein, 10 aa, Artificial Sequence
  Artificially Synthesized Peptide
VPFIGLSMVH

SEQ ID NO: 771 - protein, 10 aa, Artificial Sequence
  Artificially Synthesized Peptide
LAFPLCSLYL

SEQ ID NO: 772 - protein, 10 aa, Artificial Sequence
  Artificially Synthesized Peptide
LSMVHRFSKR

SEQ ID NO: 773 - protein, 10 aa, Artificial Sequence
  Artificially Synthesized Peptide
VVYGLIVIIS

SEQ ID NO: 774 - protein, 10 aa, Artificial Sequence
  Artificially Synthesized Peptide
NIYLLVPPVL

SEQ ID NO: 775 - protein, 10 aa, Artificial Sequence
  Artificially Synthesized Peptide
TKIGVAAVVR

SEQ ID NO: 776 - protein, 10 aa, Artificial Sequence
  Artificially Synthesized Peptide
PFIGLSMVHR

SEQ ID NO: 777 - protein, 10 aa, Artificial Sequence
  Artificially Synthesized Peptide
SAIGLDSLLI

SEQ ID NO: 778 - protein, 10 aa, Artificial Sequence
  Artificially Synthesized Peptide
LYLIAVLGNL

SEQ ID NO: 779 - protein, 10 aa, Artificial Sequence
  Artificially Synthesized Peptide
TIIYIVRTEH

SEQ ID NO: 780 - protein, 10 aa, Artificial Sequence
  Artificially Synthesized Peptide
PVLNPIVYGV

SEQ ID NO: 781 - protein, 10 aa, Artificial Sequence
  Artificially Synthesized Peptide
YIVRTEHSLH

SEQ ID NO: 782 - protein, 10 aa, Artificial Sequence
  Artificially Synthesized Peptide
MPKMLAIFWF

SEQ ID NO: 783 - protein, 10 aa, Artificial Sequence
  Artificially Synthesized Peptide
LPVFIKQLPF

SEQ ID NO: 784 - protein, 10 aa, Artificial Sequence
  Artificially Synthesized Peptide
RFSKRRDSPL

SEQ ID NO: 785 - protein, 10 aa, Artificial Sequence
  Artificially Synthesized Peptide
NILSHSYCLH

SEQ ID NO: 786 - protein, 10 aa, Artificial Sequence
  Artificially Synthesized Peptide
VLLAMAFDRY

SEQ ID NO: 787 - protein, 10 aa, Artificial Sequence
  Artificially Synthesized Peptide
SYLLILKTVL

SEQ ID NO: 788 - protein, 10 aa, Artificial Sequence
  Artificially Synthesized Peptide
YCLHQDVMKL

SEQ ID NO: 789 - protein, 10 aa, Artificial Sequence
  Artificially Synthesized Peptide
FPLCSLYLIA

SEQ ID NO: 790 - protein, 10 aa, Artificial Sequence
  Artificially Synthesized Peptide
IYIVRTEHSL

SEQ ID NO: 791 - protein, 10 aa, Artificial Sequence
  Artificially Synthesized Peptide
PVILANIYLL

SEQ ID NO: 792 - protein, 10 aa, Artificial Sequence
  Artificially Synthesized Peptide
LPVILANIYL

SEQ ID NO: 793 - protein, 10 aa, Artificial Sequence
  Artificially Synthesized Peptide
LLVPPVLNPI

SEQ ID NO: 794 - protein, 10 aa, Artificial Sequence
  Artificially Synthesized Peptide
AQAKAFGTCV

SEQ ID NO: 795 - protein, 10 aa, Artificial Sequence
  Artificially Synthesized Peptide
KMLAIFWFNS

SEQ ID NO: 796 - protein, 10 aa, Artificial Sequence
  Artificially Synthesized Peptide
KEIRQRILRL

SEQ ID NO: 797 - protein, 10 aa, Artificial Sequence
  Artificially Synthesized Peptide
LTREAQAKAF

SEQ ID NO: 798 - protein, 10 aa, Artificial Sequence
  Artificially Synthesized Peptide
KTVLGLTREA

SEQ ID NO: 799 - protein, 10 aa, Artificial Sequence
  Artificially Synthesized Peptide
SLSGMESTVL

SEQ ID NO: 800 - protein, 10 aa, Artificial Sequence
  Artificially Synthesized Peptide
SATYFILIGL

SEQ ID NO: 801 - protein, 9 aa, Artificial Sequence
  Artificially Synthesized Peptide
RYVAICHPL

SEQ ID NO: 802 - protein, 9 aa, Artificial Sequence
  Artificially Synthesized Peptide
IYLLVPPVL

SEQ ID NO: 803 - protein, 9 aa, Artificial Sequence
  Artificially Synthesized Peptide
VYGVKTKEI

SEQ ID NO: 804 - protein, 9 aa, Artificial Sequence
  Artificially Synthesized Peptide
AFPLCSLYL

SEQ ID NO: 805 - protein, 9 aa, Artificial Sequence
  Artificially Synthesized Peptide
SYCLHQDVM

SEQ ID NO: 806 - protein, 9 aa, Artificial Sequence
  Artificially Synthesized Peptide
IFYVPFIGL

SEQ ID NO: 807 - protein, 9 aa, Artificial Sequence
  Artificially Synthesized Peptide
WFNSTTIQF

SEQ ID NO: 808 - protein, 9 aa, Artificial Sequence
  Artificially Synthesized Peptide
SYLLILKTV

SEQ ID NO: 809 - protein, 9 aa, Artificial Sequence
  Artificially Synthesized Peptide
RGAALMAPL

SEQ ID NO: 810 - protein, 9 aa, Artificial Sequence
  Artificially Synthesized Peptide
FYVPFIGLS

SEQ ID NO: 811 - protein, 9 aa, Artificial Sequence
  Artificially Synthesized Peptide
MYIFLCMLS

SEQ ID NO: 812 - protein, 9 aa, Artificial Sequence
  Artificially Synthesized Peptide
YLIAVLGNL

SEQ ID NO: 813 - protein, 9 aa, Artificial Sequence
  Artificially Synthesized Peptide
LYLIAVLGN

SEQ ID NO: 814 - protein, 9 aa, Artificial Sequence
  Artificially Synthesized Peptide
VFIFYVPFI

SEQ ID NO: 815 - protein, 9 aa, Artificial Sequence
  Artificially Synthesized Peptide
IFLCMLSGI

SEQ ID NO: 816 - protein, 9 aa, Artificial Sequence
  Artificially Synthesized Peptide
IYIVRTEHS

SEQ ID NO: 817 - protein, 9 aa, Artificial Sequence
  Artificially Synthesized Peptide
SLLISFSYL

SEQ ID NO: 818 - protein, 9 aa, Artificial Sequence
  Artificially Synthesized Peptide
SAIGLDSLL

SEQ ID NO: 819 - protein, 9 aa, Artificial Sequence
  Artificially Synthesized Peptide
YLLILKTVL

SEQ ID NO: 820 - protein, 9 aa, Artificial Sequence
  Artificially Synthesized Peptide
CSLYLIAVL

SEQ ID NO: 821 - protein, 9 aa, Artificial Sequence
  Artificially Synthesized Peptide
GLEEAQFWL

SEQ ID NO: 822 - protein, 9 aa, Artificial Sequence
  Artificially Synthesized Peptide
SGMESTVLL

SEQ ID NO: 823 - protein, 9 aa, Artificial Sequence
  Artificially Synthesized Peptide
VYGLIVIIS

SEQ ID NO: 824 - protein, 9 aa, Artificial Sequence
  Artificially Synthesized Peptide
TTIQFDACL

SEQ ID NO: 825 - protein, 9 aa, Artificial Sequence
  Artificially Synthesized Peptide
CMLSGIDIL

SEQ ID NO: 826 - protein, 9 aa, Artificial Sequence
  Artificially Synthesized Peptide
NILSHSYCL

SEQ ID NO: 827 - protein, 9 aa, Artificial Sequence
  Artificially Synthesized Peptide
YIVRTEHSL

SEQ ID NO: 828 - protein, 9 aa, Artificial Sequence
  Artificially Synthesized Peptide
VILANIYLL

SEQ ID NO: 829 - protein, 9 aa, Artificial Sequence
  Artificially Synthesized Peptide
AAVVRGAAL

SEQ ID NO: 830 - protein, 9 aa, Artificial Sequence
  Artificially Synthesized Peptide
LQIFAIHSL

SEQ ID NO: 831 - protein, 9 aa, Artificial Sequence
  Artificially Synthesized Peptide
LILKTVLGL

SEQ ID NO: 832 - protein, 9 aa, Artificial Sequence
  Artificially Synthesized Peptide
HPLRHATVL

SEQ ID NO: 833 - protein, 9 aa, Artificial Sequence
  Artificially Synthesized Peptide
LLISFSYLL

SEQ ID NO: 834 - protein, 9 aa, Artificial Sequence
  Artificially Synthesized Peptide
TIQFDACLL

SEQ ID NO: 835 - protein, 9 aa, Artificial Sequence
  Artificially Synthesized Peptide
FILIGLPGL

SEQ ID NO: 836 - protein, 9 aa, Artificial Sequence
  Artificially Synthesized Peptide
IVIISAIGL

SEQ ID NO: 837 - protein, 9 aa, Artificial Sequence
  Artificially Synthesized Peptide
ATYFILIGL

SEQ ID NO: 838 - protein, 9 aa, Artificial Sequence
  Artificially Synthesized Peptide
IFWFNSTTI

SEQ ID NO: 839 - protein, 9 aa, Artificial Sequence
  Artificially Synthesized Peptide
QFDACLLQI

SEQ ID NO: 840 - protein, 9 aa, Artificial Sequence
  Artificially Synthesized Peptide
AQFWLAFPL

SEQ ID NO: 841 - protein, 9 aa, Artificial Sequence
  Artificially Synthesized Peptide
LPFCRSNIL

SEQ ID NO: 842 - protein, 9 aa, Artificial Sequence
  Artificially Synthesized Peptide
CLHQDVMKL

SEQ ID NO: 843 - protein, 9 aa, Artificial Sequence
  Artificially Synthesized Peptide
RVNVVYGLI

SEQ ID NO: 844 - protein, 9 aa, Artificial Sequence
  Artificially Synthesized Peptide
KTKEIRQRI

SEQ ID NO: 845 - protein, 9 aa, Artificial Sequence
  Artificially Synthesized Peptide
FSKRRDSPL

SEQ ID NO: 846 - protein, 9 aa, Artificial Sequence
  Artificially Synthesized Peptide
ISAIGLDSL

SEQ ID NO: 847 - protein, 9 aa, Artificial Sequence
  Artificially Synthesized Peptide
ISFSYLLIL

SEQ ID NO: 848 - protein, 9 aa, Artificial Sequence
  Artificially Synthesized Peptide
WLAFPLCSL

SEQ ID NO: 849 - protein, 9 aa, Artificial Sequence
  Artificially Synthesized Peptide
STSSMPKML

SEQ ID NO: 850 - protein, 9 aa, Artificial Sequence
  Artificially Synthesized Peptide
ESSATYFIL

SEQ ID NO: 851 - protein, 9 aa, Artificial Sequence
  Artificially Synthesized Peptide
LSGMESTVL

SEQ ID NO: 852 - protein, 9 aa, Artificial Sequence
  Artificially Synthesized Peptide
EIRQRILRL

SEQ ID NO: 853 - protein, 9 aa, Artificial Sequence
  Artificially Synthesized Peptide
STVLLAMAF

SEQ ID NO: 854 - protein, 9 aa, Artificial Sequence
  Artificially Synthesized Peptide
LVPPVLNPI

SEQ ID NO: 855 - protein, 9 aa, Artificial Sequence
  Artificially Synthesized Peptide
ALMAPLPVF

SEQ ID NO: 856 - protein, 9 aa, Artificial Sequence
  Artificially Synthesized Peptide
IGLSMVHRF

SEQ ID NO: 857 - protein, 9 aa, Artificial Sequence
  Artificially Synthesized Peptide
GNESSATYF

SEQ ID NO: 858 - protein, 9 aa, Artificial Sequence
  Artificially Synthesized Peptide
SMPKMLAIF

SEQ ID NO: 859 - protein, 9 aa, Artificial Sequence
  Artificially Synthesized Peptide
CVSHVCAVF

SEQ ID NO: 860 - protein, 9 aa, Artificial Sequence
  Artificially Synthesized Peptide
GLDSLLISF

SEQ ID NO: 861 - protein, 9 aa, Artificial Sequence
  Artificially Synthesized Peptide
SLHEPMYIF

SEQ ID NO: 862 - protein, 9 aa, Artificial Sequence
  Artificially Synthesized Peptide
GLIVIISAI

SEQ ID NO: 863 - protein, 9 aa, Artificial Sequence
  Artificially Synthesized Peptide
LPGLEEAQF

SEQ ID NO: 864 - protein, 9 aa, Artificial Sequence
  Artificially Synthesized Peptide
AVFIFYVPF

SEQ ID NO: 865 - protein, 9 aa, Artificial Sequence
  Artificially Synthesized Peptide
LTLPRVTKI

SEQ ID NO: 866 - protein, 9 aa, Artificial Sequence
  Artificially Synthesized Peptide
SSMPKMLAI

SEQ ID NO: 867 - protein, 9 aa, Artificial Sequence
  Artificially Synthesized Peptide
NVVYGLIVI

SEQ ID NO: 868 - protein, 9 aa, Artificial Sequence
  Artificially Synthesized Peptide
ACLLQIFAI

SEQ ID NO: 869 - protein, 9 aa, Artificial Sequence
  Artificially Synthesized Peptide
LGNLTIIYI

SEQ ID NO: 870 - protein, 9 aa, Artificial Sequence
  Artificially Synthesized Peptide
HSLHEPMYI

SEQ ID NO: 871 - protein, 9 aa, Artificial Sequence
  Artificially Synthesized Peptide
LCMLSGIDI

SEQ ID NO: 872 - protein, 9 aa, Artificial Sequence
  Artificially Synthesized Peptide
IAVLGNLTI

SEQ ID NO: 873 - protein, 9 aa, Artificial Sequence
  Artificially Synthesized Peptide
QLPFCRSNI

SEQ ID NO: 874 - protein, 9 aa, Artificial Sequence
  Artificially Synthesized Peptide
AVLGNLTII

SEQ ID NO: 875 - protein, 9 aa, Artificial Sequence
  Artificially Synthesized Peptide
FPLCSLYLI

SEQ ID NO: 876 - protein, 9 aa, Artificial Sequence
  Artificially Synthesized Peptide
LMAPLPVFI

SEQ ID NO: 877 - protein, 9 aa, Artificial Sequence
  Artificially Synthesized Peptide
MLSGIDILI

SEQ ID NO: 878 - protein, 9 aa, Artificial Sequence
  Artificially Synthesized Peptide
EPMYIFLCM

SEQ ID NO: 879 - protein, 9 aa, Artificial Sequence
  Artificially Synthesized Peptide
MAFDRYVAI

SEQ ID NO: 880 - protein, 9 aa, Artificial Sequence
  Artificially Synthesized Peptide
SSATYFILI

SEQ ID NO: 881 - protein, 9 aa, Artificial Sequence
  Artificially Synthesized Peptide
VVYGLIVII

SEQ ID NO: 882 - protein, 9 aa, Artificial Sequence
  Artificially Synthesized Peptide
RDSPLPVIL

SEQ ID NO: 883 - protein, 9 aa, Artificial Sequence
  Artificially Synthesized Peptide
YVPFIGLSM

SEQ ID NO: 884 - protein, 9 aa, Artificial Sequence
  Artificially Synthesized Peptide
VSHVCAVFI

SEQ ID NO: 885 - protein, 9 aa, Artificial Sequence
  Artificially Synthesized Peptide
AIGLDSLLI

SEQ ID NO: 886 - protein, 9 aa, Artificial Sequence
  Artificially Synthesized Peptide
VMKLACDDI

SEQ ID NO: 887 - protein, 9 aa, Artificial Sequence
  Artificially Synthesized Peptide
LISFSYLLI

SEQ ID NO: 888 - protein, 9 aa, Artificial Sequence
  Artificially Synthesized Peptide
IRVNVVYGL

SEQ ID NO: 889 - protein, 9 aa, Artificial Sequence
  Artificially Synthesized Peptide
DILISTSSM

SEQ ID NO: 890 - protein, 9 aa, Artificial Sequence
  Artificially Synthesized Peptide
VFIKQLPFC

SEQ ID NO: 891 - protein, 9 aa, Artificial Sequence
  Artificially Synthesized Peptide
FAIHSLSGM

SEQ ID NO: 892 - protein, 9 aa, Artificial Sequence
  Artificially Synthesized Peptide
AVVRGAALM

SEQ ID NO: 893 - protein, 9 aa, Artificial Sequence
  Artificially Synthesized Peptide
LHEPMYIFL

SEQ ID NO: 894 - protein, 9 aa, Artificial Sequence
  Artificially Synthesized Peptide
TYFILIGLP

SEQ ID NO: 895 - protein, 9 aa, Artificial Sequence
  Artificially Synthesized Peptide
PLPVFIKQL

SEQ ID NO: 896 - protein, 9 aa, Artificial Sequence
  Artificially Synthesized Peptide
QFWLAFPLC

SEQ ID NO: 897 - protein, 9 aa, Artificial Sequence
  Artificially Synthesized Peptide
TKEIRQRIL

SEQ ID NO: 898 - protein, 9 aa, Artificial Sequence
  Artificially Synthesized Peptide
PVILANIYL

SEQ ID NO: 899 - protein, 9 aa, Artificial Sequence
  Artificially Synthesized Peptide
ISTSSMPKM

SEQ ID NO: 900 - protein, 9 aa, Artificial Sequence
  Artificially Synthesized Peptide
KMLAIFWFN

SEQ ID NO: 901 - protein, 10 aa, Artificial Sequence
  Artificially Synthesized Peptide
LYLIAVLGNL

SEQ ID NO: 902 - protein, 10 aa, Artificial Sequence
  Artificially Synthesized Peptide
SYLLILKTVL

SEQ ID NO: 903 - protein, 10 aa, Artificial Sequence
  Artificially Synthesized Peptide
IYIVRTEHSL

SEQ ID NO: 904 - protein, 10 aa, Artificial Sequence
  Artificially Synthesized Peptide
FYVPFIGLSM

SEQ ID NO: 905 - protein, 10 aa, Artificial Sequence
  Artificially Synthesized Peptide
RFSKRRDSPL

SEQ ID NO: 906 - protein, 10 aa, Artificial Sequence
  Artificially Synthesized Peptide
YFILIGLPGL

SEQ ID NO: 907 - protein, 10 aa, Artificial Sequence
  Artificially Synthesized Peptide
QFDACLLQIF

SEQ ID NO: 908 - protein, 10 aa, Artificial Sequence
  Artificially Synthesized Peptide
KTKEIRQRIL

SEQ ID NO: 909 - protein, 10 aa, Artificial Sequence
  Artificially Synthesized Peptide
AFPLCSLYLI

SEQ ID NO: 910 - protein, 10 aa, Artificial Sequence
  Artificially Synthesized Peptide
IYLLVPPVLN

SEQ ID NO: 911 - protein, 10 aa, Artificial Sequence
  Artificially Synthesized Peptide
EAQFWLAFPL

SEQ ID NO: 912 - protein, 10 aa, Artificial Sequence
  Artificially Synthesized Peptide
QLPFCRSNIL

SEQ ID NO: 913 - protein, 10 aa, Artificial Sequence
  Artificially Synthesized Peptide
APLPVFIKQL

SEQ ID NO: 914 - protein, 10 aa, Artificial Sequence
  Artificially Synthesized Peptide
DSLLISFSYL

SEQ ID NO: 915 - protein, 10 aa, Artificial Sequence
  Artificially Synthesized Peptide
VYGLIVIISA

SEQ ID NO: 916 - protein, 10 aa, Artificial Sequence
  Artificially Synthesized Peptide
YCLHQDVMKL

SEQ ID NO: 917 - protein, 10 aa, Artificial Sequence
  Artificially Synthesized Peptide
LCMLSGIDIL

SEQ ID NO: 918 - protein, 10 aa, Artificial Sequence
  Artificially Synthesized Peptide
TTIQFDACLL

SEQ ID NO: 919 - protein, 10 aa, Artificial Sequence
  Artificially Synthesized Peptide
FWLAFPLCSL

SEQ ID NO: 920 - protein, 10 aa, Artificial Sequence
  Artificially Synthesized Peptide
SLLISFSYLL

SEQ ID NO: 921 - protein, 10 aa, Artificial Sequence
  Artificially Synthesized Peptide
EPMYIFLCML

SEQ ID NO: 922 - protein, 10 aa, Artificial Sequence
  Artificially Synthesized Peptide
LPVILANIYL

SEQ ID NO: 923 - protein, 10 aa, Artificial Sequence
  Artificially Synthesized Peptide
LLILKTVLGL

SEQ ID NO: 924 - protein, 10 aa, Artificial Sequence
  Artificially Synthesized Peptide
LIVIISAIGL

SEQ ID NO: 925 - protein, 10 aa, Artificial Sequence
  Artificially Synthesized Peptide
SNILSHSYCL

SEQ ID NO: 926 - protein, 10 aa, Artificial Sequence
  Artificially Synthesized Peptide
LLQIFAIHSL

SEQ ID NO: 927 - protein, 10 aa, Artificial Sequence
  Artificially Synthesized Peptide
NIYLLVPPVL

SEQ ID NO: 928 - protein, 10 aa, Artificial Sequence
  Artificially Synthesized Peptide
DIRVNVVYGL

SEQ ID NO: 929 - protein, 10 aa, Artificial Sequence
  Artificially Synthesized Peptide
SATYFILIGL

SEQ ID NO: 930 - protein, 10 aa, Artificial Sequence
  Artificially Synthesized Peptide
FIFYVPFIGL

SEQ ID NO: 931 - protein, 10 aa, Artificial Sequence
  Artificially Synthesized Peptide
LAFPLCSLYL

SEQ ID NO: 932 - protein, 10 aa, Artificial Sequence
  Artificially Synthesized Peptide
SLHEPMYIFL

SEQ ID NO: 933 - protein, 10 aa, Artificial Sequence
  Artificially Synthesized Peptide
LCSLYLIAVL

SEQ ID NO: 934 - protein, 10 aa, Artificial Sequence
  Artificially Synthesized Peptide
ISAIGLDSLL

SEQ ID NO: 935 - protein, 10 aa, Artificial Sequence
  Artificially Synthesized Peptide
IGLDSLLISF

SEQ ID NO: 936 - protein, 10 aa, Artificial Sequence
  Artificially Synthesized Peptide
TCVSHVCAVF

SEQ ID NO: 937 - protein, 10 aa, Artificial Sequence
  Artificially Synthesized Peptide
LISFSYLLIL

SEQ ID NO: 938 - protein, 10 aa, Artificial Sequence
  Artificially Synthesized Peptide
SLSGMESTVL

SEQ ID NO: 939 - protein, 10 aa, Artificial Sequence
  Artificially Synthesized Peptide
VAAVVRGAAL

SEQ ID NO: 940 - protein, 10 aa, Artificial Sequence
  Artificially Synthesized Peptide
IISAIGLDSL

SEQ ID NO: 941 - protein, 10 aa, Artificial Sequence
  Artificially Synthesized Peptide
STTIQFDACL

SEQ ID NO: 942 - protein, 10 aa, Artificial Sequence
  Artificially Synthesized Peptide
ISTSSMPKML

SEQ ID NO: 943 - protein, 10 aa, Artificial Sequence
  Artificially Synthesized Peptide
LSGMESTVLL

SEQ ID NO: 944 - protein, 10 aa, Artificial Sequence
  Artificially Synthesized Peptide
KQLPFCRSNI

SEQ ID NO: 945 - protein, 10 aa, Artificial Sequence
  Artificially Synthesized Peptide
SSMPKMLAIF

SEQ ID NO: 946 - protein, 10 aa, Artificial Sequence
  Artificially Synthesized Peptide
NGNESSATYF

SEQ ID NO: 947 - protein, 10 aa, Artificial Sequence
  Artificially Synthesized Peptide
LLVPPVLNPI

SEQ ID NO: 948 - protein, 10 aa, Artificial Sequence
  Artificially Synthesized Peptide
HSLHEPMYIF

SEQ ID NO: 949 - protein, 10 aa, Artificial Sequence
  Artificially Synthesized Peptide
LPVFIKQLPF

SEQ ID NO: 950 - protein, 10 aa, Artificial Sequence
  Artificially Synthesized Peptide
AALMAPLPVF

SEQ ID NO: 951 - protein, 10 aa, Artificial Sequence
  Artificially Synthesized Peptide
CAVFIFYVPF

SEQ ID NO: 952 - protein, 10 aa, Artificial Sequence
  Artificially Synthesized Peptide
GLPGLEEAQF

SEQ ID NO: 953 - protein, 10 aa, Artificial Sequence
  Artificially Synthesized Peptide
EIRQRILRLF

SEQ ID NO: 954 - protein, 10 aa, Artificial Sequence
  Artificially Synthesized Peptide
SPLPVILANI

SEQ ID NO: 955 - protein, 10 aa, Artificial Sequence
  Artificially Synthesized Peptide
IFAIHSLSGM

SEQ ID NO: 956 - protein, 10 aa, Artificial Sequence
  Artificially Synthesized Peptide
LTREAQAKAF

SEQ ID NO: 957 - protein, 10 aa, Artificial Sequence
  Artificially Synthesized Peptide
ESTVLLAMAF

SEQ ID NO: 958 - protein, 10 aa, Artificial Sequence
  Artificially Synthesized Peptide
CMLSGIDILI

SEQ ID NO: 959 - protein, 10 aa, Artificial Sequence
  Artificially Synthesized Peptide
YGLIVIISAI

SEQ ID NO: 960 - protein, 10 aa, Artificial Sequence
  Artificially Synthesized Peptide
FIGLSMVHRF

SEQ ID NO: 961 - protein, 10 aa, Artificial Sequence
  Artificially Synthesized Peptide
VSHVCAVFIF

SEQ ID NO: 962 - protein, 10 aa, Artificial Sequence
  Artificially Synthesized Peptide
FWFNSTTIQF

SEQ ID NO: 963 - protein, 10 aa, Artificial Sequence
  Artificially Synthesized Peptide
MPKMLAIFWF

SEQ ID NO: 964 - protein, 10 aa, Artificial Sequence
  Artificially Synthesized Peptide
ALMAPLPVFI

SEQ ID NO: 965 - protein, 10 aa, Artificial Sequence
  Artificially Synthesized Peptide
RTEHSLHEPM

SEQ ID NO: 966 - protein, 10 aa, Artificial Sequence
  Artificially Synthesized Peptide
NVVYGLIVII

SEQ ID NO: 967 - protein, 10 aa, Artificial Sequence
  Artificially Synthesized Peptide
GNESSATYFI

SEQ ID NO: 968 - protein, 10 aa, Artificial Sequence
  Artificially Synthesized Peptide
RYVAICHPLR

SEQ ID NO: 969 - protein, 10 aa, Artificial Sequence
  Artificially Synthesized Peptide
LLISFSYLLI

SEQ ID NO: 970 - protein, 10 aa, Artificial Sequence
  Artificially Synthesized Peptide
SAIGLDSLLI

SEQ ID NO: 971 - protein, 10 aa, Artificial Sequence
  Artificially Synthesized Peptide
VNVVYGLIVI

SEQ ID NO: 972 - protein, 10 aa, Artificial Sequence
  Artificially Synthesized Peptide
DVMKLACDDI

SEQ ID NO: 973 - protein, 10 aa, Artificial Sequence
  Artificially Synthesized Peptide
IAVLGNLTII

SEQ ID NO: 974 - protein, 10 aa, Artificial Sequence
  Artificially Synthesized Peptide
IQFDACLLQI

SEQ ID NO: 975 - protein, 10 aa, Artificial Sequence
  Artificially Synthesized Peptide
KEIRQRILRL

SEQ ID NO: 976 - protein, 10 aa, Artificial Sequence
  Artificially Synthesized Peptide
ESSATYFILI

SEQ ID NO: 977 - protein, 10 aa, Artificial Sequence
  Artificially Synthesized Peptide
IVYGVKTKEI

SEQ ID NO: 978 - protein, 10 aa, Artificial Sequence
  Artificially Synthesized Peptide
VLTLPRVTKI

SEQ ID NO: 979 - protein, 10 aa, Artificial Sequence
  Artificially Synthesized Peptide
GMESTVLLAM

SEQ ID NO: 980 - protein, 10 aa, Artificial Sequence
  Artificially Synthesized Peptide
AIFWFNSTTI

SEQ ID NO: 981 - protein, 10 aa, Artificial Sequence
  Artificially Synthesized Peptide
VLGNLTIIYI

SEQ ID NO: 982 - protein, 10 aa, Artificial Sequence
  Artificially Synthesized Peptide
DACLLQIFAI

SEQ ID NO: 983 - protein, 10 aa, Artificial Sequence
  Artificially Synthesized Peptide
AMAFDRYVAI

SEQ ID NO: 984 - protein, 10 aa, Artificial Sequence
  Artificially Synthesized Peptide
TSSMPKMLAI

SEQ ID NO: 985 - protein, 10 aa, Artificial Sequence
  Artificially Synthesized Peptide
LIAVLGNLTI

SEQ ID NO: 986 - protein, 10 aa, Artificial Sequence
  Artificially Synthesized Peptide
AVFIFYVPFI

SEQ ID NO: 987 - protein, 10 aa, Artificial Sequence
  Artificially Synthesized Peptide
FLCMLSGIDI

SEQ ID NO: 988 - protein, 10 aa, Artificial Sequence
  Artificially Synthesized Peptide
YIFLCMLSGI

SEQ ID NO: 989 - protein, 10 aa, Artificial Sequence
  Artificially Synthesized Peptide
CVSHVCAVFI

SEQ ID NO: 990 - protein, 10 aa, Artificial Sequence
  Artificially Synthesized Peptide
RRDSPLPVIL

SEQ ID NO: 991 - protein, 10 aa, Artificial Sequence
  Artificially Synthesized Peptide
MYIFLCMLSG

SEQ ID NO: 992 - protein, 10 aa, Artificial Sequence
  Artificially Synthesized Peptide
AAVVRGAALM

SEQ ID NO: 993 - protein, 10 aa, Artificial Sequence
  Artificially Synthesized Peptide
PGLEEAQFWL

SEQ ID NO: 994 - protein, 10 aa, Artificial Sequence
  Artificially Synthesized Peptide
TYFILIGLPG

SEQ ID NO: 995 - protein, 10 aa, Artificial Sequence
  Artificially Synthesized Peptide
AFGTCVSHVC

SEQ ID NO: 996 - protein, 10 aa, Artificial Sequence
  Artificially Synthesized Peptide
SFSYLLILKT

SEQ ID NO: 997 - protein, 10 aa, Artificial Sequence
  Artificially Synthesized Peptide
CHPLRHATVL

SEQ ID NO: 998 - protein, 10 aa, Artificial Sequence
  Artificially Synthesized Peptide
PVILANIYLL

SEQ ID NO: 999 - protein, 10 aa, Artificial Sequence
  Artificially Synthesized Peptide
DRYVAICHPL

SEQ ID NO: 1000 - protein, 10 aa, Artificial Sequence
  Artificially Synthesized Peptide
LISTSSMPKM

SEQ ID NO: 1001 - protein, 9 aa, Artificial Sequence
  Artificially Synthesized Peptide
HPLRHATVL

SEQ ID NO: 1002 - protein, 9 aa, Artificial Sequence
  Artificially Synthesized Peptide
LPFCRSNIL

SEQ ID NO: 1003 - protein, 9 aa, Artificial Sequence
  Artificially Synthesized Peptide
EPMYIFLCM

SEQ ID NO: 1004 - protein, 9 aa, Artificial Sequence
  Artificially Synthesized Peptide
EIRQRILRL

SEQ ID NO: 1005 - protein, 9 aa, Artificial Sequence
  Artificially Synthesized Peptide
LPRVTKIGV

SEQ ID NO: 1006 - protein, 9 aa, Artificial Sequence
  Artificially Synthesized Peptide
AAVVRGAAL

SEQ ID NO: 1007 - protein, 9 aa, Artificial Sequence
  Artificially Synthesized Peptide
IVIISAIGL

SEQ ID NO: 1008 - protein, 9 aa, Artificial Sequence
  Artificially Synthesized Peptide
AVVRGAALM

SEQ ID NO: 1009 - protein, 9 aa, Artificial Sequence
  Artificially Synthesized Peptide
SGMESTVLL

SEQ ID NO: 1010 - protein, 9 aa, Artificial Sequence
  Artificially Synthesized Peptide
ATYFILIGL

SEQ ID NO: 1011 - protein, 9 aa, Artificial Sequence
  Artificially Synthesized Peptide
AQFWLAFPL

SEQ ID NO: 1012 - protein, 9 aa, Artificial Sequence
  Artificially Synthesized Peptide
SAIGLDSLL

SEQ ID NO: 1013 - protein, 9 aa, Artificial Sequence
  Artificially Synthesized Peptide
FPLCSLYLI

SEQ ID NO: 1014 - protein, 9 aa, Artificial Sequence
  Artificially Synthesized Peptide
WLAFPLCSL

SEQ ID NO: 1015 - protein, 9 aa, Artificial Sequence
  Artificially Synthesized Peptide
AVLGNLTII

SEQ ID NO: 1016 - protein, 9 aa, Artificial Sequence
  Artificially Synthesized Peptide
VVRGAALMA

SEQ ID NO: 1017 - protein, 9 aa, Artificial Sequence
  Artificially Synthesized Peptide
YVPFIGLSM

SEQ ID NO: 1018 - protein, 9 aa, Artificial Sequence
  Artificially Synthesized Peptide
LSGMESTVL

SEQ ID NO: 1019 - protein, 9 aa, Artificial Sequence
  Artificially Synthesized Peptide
VILANIYLL

SEQ ID NO: 1020 - protein, 9 aa, Artificial Sequence
  Artificially Synthesized Peptide
ISFSYLLIL

SEQ ID NO: 1021 - protein, 9 aa, Artificial Sequence
  Artificially Synthesized Peptide
YLLILKTVL

SEQ ID NO: 1022 - protein, 9 aa, Artificial Sequence
  Artificially Synthesized Peptide
CLHQDVMKL

SEQ ID NO: 1023 - protein, 9 aa, Artificial Sequence
  Artificially Synthesized Peptide
VPFIGLSMV

SEQ ID NO: 1024 - protein, 9 aa, Artificial Sequence
  Artificially Synthesized Peptide
LILKTVLGL

SEQ ID NO: 1025 - protein, 9 aa, Artificial Sequence
  Artificially Synthesized Peptide
TIQFDACLL

SEQ ID NO: 1026 - protein, 9 aa, Artificial Sequence
  Artificially Synthesized Peptide
STSSMPKML

SEQ ID NO: 1027 - protein, 9 aa, Artificial Sequence
  Artificially Synthesized Peptide
YIVRTEHSL

SEQ ID NO: 1028 - protein, 9 aa, Artificial Sequence
  Artificially Synthesized Peptide
RGAALMAPL

SEQ ID NO: 1029 - protein, 9 aa, Artificial Sequence
  Artificially Synthesized Peptide
TTIQFDACL

SEQ ID NO: 1030 - protein, 9 aa, Artificial Sequence
  Artificially Synthesized Peptide
FILIGLPGL

SEQ ID NO: 1031 - protein, 9 aa, Artificial Sequence
  Artificially Synthesized Peptide
LQIFAIHSL

SEQ ID NO: 1032 - protein, 9 aa, Artificial Sequence
  Artificially Synthesized Peptide
SLLISFSYL

SEQ ID NO: 1033 - protein, 9 aa, Artificial Sequence
  Artificially Synthesized Peptide
NILSHSYCL

SEQ ID NO: 1034 - protein, 9 aa, Artificial Sequence
  Artificially Synthesized Peptide
FSKRRDSPL

SEQ ID NO: 1035 - protein, 9 aa, Artificial Sequence
  Artificially Synthesized Peptide
YLIAVLGNL

SEQ ID NO: 1036 - protein, 9 aa, Artificial Sequence
  Artificially Synthesized Peptide
VPPVLNPIV

SEQ ID NO: 1037 - protein, 9 aa, Artificial Sequence
  Artificially Synthesized Peptide
LLISFSYLL

SEQ ID NO: 1038 - protein, 9 aa, Artificial Sequence
  Artificially Synthesized Peptide
CSLYLIAVL

SEQ ID NO: 1039 - protein, 9 aa, Artificial Sequence
  Artificially Synthesized Peptide
CMLSGIDIL

SEQ ID NO: 1040 - protein, 9 aa, Artificial Sequence
  Artificially Synthesized Peptide
ISAIGLDSL

SEQ ID NO: 1041 - protein, 9 aa, Artificial Sequence
  Artificially Synthesized Peptide
ESSATYFIL

SEQ ID NO: 1042 - protein, 9 aa, Artificial Sequence
  Artificially Synthesized Peptide
FAIHSLSGM

SEQ ID NO: 1043 - protein, 9 aa, Artificial Sequence
  Artificially Synthesized Peptide
LVPPVLNPI

SEQ ID NO: 1044 - protein, 9 aa, Artificial Sequence
  Artificially Synthesized Peptide
NPIVYGVKT

SEQ ID NO: 1045 - protein, 9 aa, Artificial Sequence
  Artificially Synthesized Peptide
RVNVVYGLI

SEQ ID NO: 1046 - protein, 9 aa, Artificial Sequence
  Artificially Synthesized Peptide
NVVYGLIVI

SEQ ID NO: 1047 - protein, 9 aa, Artificial Sequence
  Artificially Synthesized Peptide
DPNGNESSA

SEQ ID NO: 1048 - protein, 9 aa, Artificial Sequence
  Artificially Synthesized Peptide
VVYGLIVII

SEQ ID NO: 1049 - protein, 9 aa, Artificial Sequence
  Artificially Synthesized Peptide
PVILANIYL

SEQ ID NO: 1050 - protein, 9 aa, Artificial Sequence
  Artificially Synthesized Peptide
LAMAFDRYV

SEQ ID NO: 1051 - protein, 9 aa, Artificial Sequence
  Artificially Synthesized Peptide
AALMAPLPV

SEQ ID NO: 1052 - protein, 9 aa, Artificial Sequence
  Artificially Synthesized Peptide
IAVLGNLTI

SEQ ID NO: 1053 - protein, 9 aa, Artificial Sequence
  Artificially Synthesized Peptide
GLEEAQFWL

SEQ ID NO: 1054 - protein, 9 aa, Artificial Sequence
  Artificially Synthesized Peptide
ACLLQIFAI

SEQ ID NO: 1055 - protein, 9 aa, Artificial Sequence
  Artificially Synthesized Peptide
MAFDRYVAI

SEQ ID NO: 1056 - protein, 9 aa, Artificial Sequence
  Artificially Synthesized Peptide
AIGLDSLLI

SEQ ID NO: 1057 - protein, 9 aa, Artificial Sequence
  Artificially Synthesized Peptide
SSMPKMLAI

SEQ ID NO: 1058 - protein, 9 aa, Artificial Sequence
  Artificially Synthesized Peptide
LCMLSGIDI

SEQ ID NO: 1059 - protein, 9 aa, Artificial Sequence
  Artificially Synthesized Peptide
AFPLCSLYL

SEQ ID NO: 1060 - protein, 9 aa, Artificial Sequence
  Artificially Synthesized Peptide
ILRLFHVAT

SEQ ID NO: 1061 - protein, 9 aa, Artificial Sequence
  Artificially Synthesized Peptide
DILISTSSM

SEQ ID NO: 1062 - protein, 9 aa, Artificial Sequence
  Artificially Synthesized Peptide
ISTSSMPKM

SEQ ID NO: 1063 - protein, 9 aa, Artificial Sequence
  Artificially Synthesized Peptide
LTREAQAKA

SEQ ID NO: 1064 - protein, 9 aa, Artificial Sequence
  Artificially Synthesized Peptide
QAKAFGTCV

SEQ ID NO: 1065 - protein, 9 aa, Artificial Sequence
  Artificially Synthesized Peptide
IFYVPFIGL

SEQ ID NO: 1066 - protein, 9 aa, Artificial Sequence
  Artificially Synthesized Peptide
QLPFCRSNI

SEQ ID NO: 1067 - protein, 9 aa, Artificial Sequence
  Artificially Synthesized Peptide
KTKEIRQRI

SEQ ID NO: 1068 - protein, 9 aa, Artificial Sequence
  Artificially Synthesized Peptide
ATVLTLPRV

SEQ ID NO: 1069 - protein, 9 aa, Artificial Sequence
  Artificially Synthesized Peptide
APLPVFIKQ

SEQ ID NO: 1070 - protein, 9 aa, Artificial Sequence
  Artificially Synthesized Peptide
GVAAVVRGA

SEQ ID NO: 1071 - protein, 9 aa, Artificial Sequence
  Artificially Synthesized Peptide
IVRTEHSLH

SEQ ID NO: 1072 - protein, 9 aa, Artificial Sequence
  Artificially Synthesized Peptide
TVLTLPRVT

SEQ ID NO: 1073 - protein, 9 aa, Artificial Sequence
  Artificially Synthesized Peptide
TVLGLTREA

SEQ ID NO: 1074 - protein, 9 aa, Artificial Sequence
  Artificially Synthesized Peptide
RVTKIGVAA

SEQ ID NO: 1075 - protein, 9 aa, Artificial Sequence
  Artificially Synthesized Peptide
AMAFDRYVA

SEQ ID NO: 1076 - protein, 9 aa, Artificial Sequence
  Artificially Synthesized Peptide
AICHPLRHA

SEQ ID NO: 1077 - protein, 9 aa, Artificial Sequence
  Artificially Synthesized Peptide
VAAVVRGAA

SEQ ID NO: 1078 - protein, 9 aa, Artificial Sequence
  Artificially Synthesized Peptide
LPVILANIY

SEQ ID NO: 1079 - protein, 9 aa, Artificial Sequence
  Artificially Synthesized Peptide
SPLPVILAN

SEQ ID NO: 1080 - protein, 9 aa, Artificial Sequence
  Artificially Synthesized Peptide
LISFSYLLI

SEQ ID NO: 1081 - protein, 9 aa, Artificial Sequence
  Artificially Synthesized Peptide
RDSPLPVIL

SEQ ID NO: 1082 - protein, 9 aa, Artificial Sequence
  Artificially Synthesized Peptide
MPKMLAIFW

SEQ ID NO: 1083 - protein, 9 aa, Artificial Sequence
  Artificially Synthesized Peptide
RYVAICHPL

SEQ ID NO: 1084 - protein, 9 aa, Artificial Sequence
  Artificially Synthesized Peptide
SSATYFILI

SEQ ID NO: 1085 - protein, 9 aa, Artificial Sequence
  Artificially Synthesized Peptide
LGNLTIIYI

SEQ ID NO: 1086 - protein, 9 aa, Artificial Sequence
  Artificially Synthesized Peptide
PMYIFLCML

SEQ ID NO: 1087 - protein, 9 aa, Artificial Sequence
  Artificially Synthesized Peptide
IYLLVPPVL

SEQ ID NO: 1088 - protein, 9 aa, Artificial Sequence
  Artificially Synthesized Peptide
MLSGIDILI

SEQ ID NO: 1089 - protein, 9 aa, Artificial Sequence
  Artificially Synthesized Peptide
LRHATVLTL

SEQ ID NO: 1090 - protein, 9 aa, Artificial Sequence
  Artificially Synthesized Peptide
HSLHEPMYI

SEQ ID NO: 1091 - protein, 9 aa, Artificial Sequence
  Artificially Synthesized Peptide
LMAPLPVFI

SEQ ID NO: 1092 - protein, 9 aa, Artificial Sequence
  Artificially Synthesized Peptide
LTLPRVTKI

SEQ ID NO: 1093 - protein, 9 aa, Artificial Sequence
  Artificially Synthesized Peptide
PLPVFIKQL

SEQ ID NO: 1094 - protein, 9 aa, Artificial Sequence
  Artificially Synthesized Peptide
LPGLEEAQF

SEQ ID NO: 1095 - protein, 9 aa, Artificial Sequence
  Artificially Synthesized Peptide
IRVNVVYGL

SEQ ID NO: 1096 - protein, 9 aa, Artificial Sequence
  Artificially Synthesized Peptide
VMKLACDDI

SEQ ID NO: 1097 - protein, 9 aa, Artificial Sequence
  Artificially Synthesized Peptide
GLIVIISAI

SEQ ID NO: 1098 - protein, 9 aa, Artificial Sequence
  Artificially Synthesized Peptide
VSHVCAVFI

SEQ ID NO: 1099 - protein, 9 aa, Artificial Sequence
  Artificially Synthesized Peptide
AIFWFNSTT

SEQ ID NO: 1100 - protein, 9 aa, Artificial Sequence
  Artificially Synthesized Peptide
AVFIFYVPF

SEQ ID NO: 1101 - protein, 10 aa, Artificial Sequence
  Artificially Synthesized Peptide
EPMYIFLCML

SEQ ID NO: 1102 - protein, 10 aa, Artificial Sequence
  Artificially Synthesized Peptide
APLPVFIKQL

SEQ ID NO: 1103 - protein, 10 aa, Artificial Sequence
  Artificially Synthesized Peptide
LPVILANIYL

SEQ ID NO: 1104 - protein, 10 aa, Artificial Sequence
  Artificially Synthesized Peptide
DIRVNVVYGL

SEQ ID NO: 1105 - protein, 10 aa, Artificial Sequence
  Artificially Synthesized Peptide
LPRVTKIGVA

SEQ ID NO: 1106 - protein, 10 aa, Artificial Sequence
  Artificially Synthesized Peptide
LCMLSGIDIL

SEQ ID NO: 1107 - protein, 10 aa, Artificial Sequence
  Artificially Synthesized Peptide
SATYFILIGL

SEQ ID NO: 1108 - protein, 10 aa, Artificial Sequence
  Artificially Synthesized Peptide
EAQFWLAFPL

SEQ ID NO: 1109 - protein, 10 aa, Artificial Sequence
  Artificially Synthesized Peptide
LAFPLCSLYL

SEQ ID NO: 1110 - protein, 10 aa, Artificial Sequence
  Artificially Synthesized Peptide
VAAVVRGAAL

SEQ ID NO: 1111 - protein, 10 aa, Artificial Sequence
  Artificially Synthesized Peptide
AAVVRGAALM

SEQ ID NO: 1112 - protein, 10 aa, Artificial Sequence
  Artificially Synthesized Peptide
SPLPVILANI

SEQ ID NO: 1113 - protein, 10 aa, Artificial Sequence
  Artificially Synthesized Peptide
DVMKLACDDI

SEQ ID NO: 1114 - protein, 10 aa, Artificial Sequence
  Artificially Synthesized Peptide
FIFYVPFIGL

SEQ ID NO: 1115 - protein, 10 aa, Artificial Sequence
  Artificially Synthesized Peptide
AVFIFYVPFI

SEQ ID NO: 1116 - protein, 10 aa, Artificial Sequence
  Artificially Synthesized Peptide
SLSGMESTVL

SEQ ID NO: 1117 - protein, 10 aa, Artificial Sequence
  Artificially Synthesized Peptide
STTIQFDACL

SEQ ID NO: 1118 - protein, 10 aa, Artificial Sequence
  Artificially Synthesized Peptide
TTIQFDACLL

SEQ ID NO: 1119 - protein, 10 aa, Artificial Sequence
  Artificially Synthesized Peptide
ISAIGLDSLL

SEQ ID NO: 1120 - protein, 10 aa, Artificial Sequence
  Artificially Synthesized Peptide
LIVIISAIGL

SEQ ID NO: 1121 - protein, 10 aa, Artificial Sequence
  Artificially Synthesized Peptide
KTKEIRQRIL

SEQ ID NO: 1122 - protein, 10 aa, Artificial Sequence
  Artificially Synthesized Peptide
DSLLISFSYL

SEQ ID NO: 1123 - protein, 10 aa, Artificial Sequence
  Artificially Synthesized Peptide
IISAIGLDSL

SEQ ID NO: 1124 - protein, 10 aa, Artificial Sequence
  Artificially Synthesized Peptide
PLRHATVLTL

SEQ ID NO: 1125 - protein, 10 aa, Artificial Sequence
  Artificially Synthesized Peptide
LLQIFAIHSL

SEQ ID NO: 1126 - protein, 10 aa, Artificial Sequence
  Artificially Synthesized Peptide
LSGMESTVLL

SEQ ID NO: 1127 - protein, 10 aa, Artificial Sequence
  Artificially Synthesized Peptide
LCSLYLIAVL

SEQ ID NO: 1128 - protein, 10 aa, Artificial Sequence
  Artificially Synthesized Peptide
LLILKTVLGL

SEQ ID NO: 1129 - protein, 10 aa, Artificial Sequence
  Artificially Synthesized Peptide
SLHEPMYIFL

SEQ ID NO: 1130 - protein, 10 aa, Artificial Sequence
  Artificially Synthesized Peptide
LISFSYLLIL

SEQ ID NO: 1131 - protein, 10 aa, Artificial Sequence
  Artificially Synthesized Peptide
SNILSHSYCL

SEQ ID NO: 1132 - protein, 10 aa, Artificial Sequence
  Artificially Synthesized Peptide
QLPFCRSNIL

SEQ ID NO: 1133 - protein, 10 aa, Artificial Sequence
  Artificially Synthesized Peptide
NIYLLVPPVL

SEQ ID NO: 1134 - protein, 10 aa, Artificial Sequence
  Artificially Synthesized Peptide
ISTSSMPKML

SEQ ID NO: 1135 - protein, 10 aa, Artificial Sequence
  Artificially Synthesized Peptide
SLLISFSYLL

SEQ ID NO: 1136 - protein, 10 aa, Artificial Sequence
  Artificially Synthesized Peptide
YCLHQDVMKL

SEQ ID NO: 1137 - protein, 10 aa, Artificial Sequence
  Artificially Synthesized Peptide
ALMAPLPVFI

SEQ ID NO: 1138 - protein, 10 aa, Artificial Sequence
  Artificially Synthesized Peptide
PVILANIYLL

SEQ ID NO: 1139 - protein, 10 aa, Artificial Sequence
  Artificially Synthesized Peptide
RQRILRLFHV

SEQ ID NO: 1140 - protein, 10 aa, Artificial Sequence
  Artificially Synthesized Peptide
NVVYGLIVII

SEQ ID NO: 1141 - protein, 10 aa, Artificial Sequence
  Artificially Synthesized Peptide
HPLRHATVLT

SEQ ID NO: 1142 - protein, 10 aa, Artificial Sequence
  Artificially Synthesized Peptide
FPLCSLYLIA

SEQ ID NO: 1143 - protein, 10 aa, Artificial Sequence
  Artificially Synthesized Peptide
CVSHVCAVFI

SEQ ID NO: 1144 - protein, 10 aa, Artificial Sequence
  Artificially Synthesized Peptide
IVYGVKTKEI

SEQ ID NO: 1145 - protein, 10 aa, Artificial Sequence
  Artificially Synthesized Peptide
DPNGNESSAT

SEQ ID NO: 1146 - protein, 10 aa, Artificial Sequence
  Artificially Synthesized Peptide
AVVRGAALMA

SEQ ID NO: 1147 - protein, 10 aa, Artificial Sequence
  Artificially Synthesized Peptide
LAMAFDRYVA

SEQ ID NO: 1148 - protein, 10 aa, Artificial Sequence
  Artificially Synthesized Peptide
IAVLGNLTII

SEQ ID NO: 1149 - protein, 10 aa, Artificial Sequence
  Artificially Synthesized Peptide
DACLLQIFAI

SEQ ID NO: 1150 - protein, 10 aa, Artificial Sequence
  Artificially Synthesized Peptide
AIFWFNSTTI

SEQ ID NO: 1151 - protein, 10 aa, Artificial Sequence
  Artificially Synthesized Peptide
AMAFDRYVAI

SEQ ID NO: 1152 - protein, 10 aa, Artificial Sequence
  Artificially Synthesized Peptide
SAIGLDSLLI

SEQ ID NO: 1153 - protein, 10 aa, Artificial Sequence
  Artificially Synthesized Peptide
RVNVVYGLIV

SEQ ID NO: 1154 - protein, 10 aa, Artificial Sequence
  Artificially Synthesized Peptide
HSYCLHQDVM

SEQ ID NO: 1155 - protein, 10 aa, Artificial Sequence
  Artificially Synthesized Peptide
YVPFIGLSMV

SEQ ID NO: 1156 - protein, 10 aa, Artificial Sequence
  Artificially Synthesized Peptide
RVTKIGVAAV

SEQ ID NO: 1157 - protein, 10 aa, Artificial Sequence
  Artificially Synthesized Peptide
LVPPVLNPIV

SEQ ID NO: 1158 - protein, 10 aa, Artificial Sequence
  Artificially Synthesized Peptide
HVCAVFIFYV

SEQ ID NO: 1159 - protein, 10 aa, Artificial Sequence
  Artificially Synthesized Peptide
LISTSSMPKM

SEQ ID NO: 1160 - protein, 10 aa, Artificial Sequence
  Artificially Synthesized Peptide
LACDDIRVNV

SEQ ID NO: 1161 - protein, 10 aa, Artificial Sequence
  Artificially Synthesized Peptide
GVAAVVRGAA

SEQ ID NO: 1162 - protein, 10 aa, Artificial Sequence
  Artificially Synthesized Peptide
FWLAFPLCSL

SEQ ID NO: 1163 - protein, 10 aa, Artificial Sequence
  Artificially Synthesized Peptide
GAALMAPLPV

SEQ ID NO: 1164 - protein, 10 aa, Artificial Sequence
  Artificially Synthesized Peptide
ANIYLLVPPV

SEQ ID NO: 1165 - protein, 10 aa, Artificial Sequence
  Artificially Synthesized Peptide
KQLPFCRSNI

SEQ ID NO: 1166 - protein, 10 aa, Artificial Sequence
  Artificially Synthesized Peptide
HATVLTLPRV

SEQ ID NO: 1167 - protein, 10 aa, Artificial Sequence
  Artificially Synthesized Peptide
KRRDSPLPVI

SEQ ID NO: 1168 - protein, 10 aa, Artificial Sequence
  Artificially Synthesized Peptide
KAFGTCVSHV

SEQ ID NO: 1169 - protein, 10 aa, Artificial Sequence
  Artificially Synthesized Peptide
AQAKAFGTCV

SEQ ID NO: 1170 - protein, 10 aa, Artificial Sequence
  Artificially Synthesized Peptide
IVRTEHSLHE

SEQ ID NO: 1171 - protein, 10 aa, Artificial Sequence
  Artificially Synthesized Peptide
VVRGAALMAP

SEQ ID NO: 1172 - protein, 10 aa, Artificial Sequence
  Artificially Synthesized Peptide
AICHPLRHAT

SEQ ID NO: 1173 - protein, 10 aa, Artificial Sequence
  Artificially Synthesized Peptide
VAICHPLRHA

SEQ ID NO: 1174 - protein, 10 aa, Artificial Sequence
  Artificially Synthesized Peptide
LYLIAVLGNL

SEQ ID NO: 1175 - protein, 10 aa, Artificial Sequence
  Artificially Synthesized Peptide
NESSATYFIL

SEQ ID NO: 1176 - protein, 10 aa, Artificial Sequence
  Artificially Synthesized Peptide
CHPLRHATVL

SEQ ID NO: 1177 - protein, 10 aa, Artificial Sequence
  Artificially Synthesized Peptide
LLISFSYLLI

SEQ ID NO: 1178 - protein, 10 aa, Artificial Sequence
  Artificially Synthesized Peptide
MPKMLAIFWF

SEQ ID NO: 1179 - protein, 10 aa, Artificial Sequence
  Artificially Synthesized Peptide
CMLSGIDILI

SEQ ID NO: 1180 - protein, 10 aa, Artificial Sequence
  Artificially Synthesized Peptide
TSSMPKMLAI

SEQ ID NO: 1181 - protein, 10 aa, Artificial Sequence
  Artificially Synthesized Peptide
LPFCRSNILS

SEQ ID NO: 1182 - protein, 10 aa, Artificial Sequence
  Artificially Synthesized Peptide
VLTLPRVTKI

SEQ ID NO: 1183 - protein, 10 aa, Artificial Sequence
  Artificially Synthesized Peptide
LPGLEEAQFW

SEQ ID NO: 1184 - protein, 10 aa, Artificial Sequence
  Artificially Synthesized Peptide
ESSATYFILI

SEQ ID NO: 1185 - protein, 10 aa, Artificial Sequence
  Artificially Synthesized Peptide
DRYVAICHPL

SEQ ID NO: 1186 - protein, 10 aa, Artificial Sequence
  Artificially Synthesized Peptide
KEIRQRILRL

SEQ ID NO: 1187 - protein, 10 aa, Artificial Sequence
  Artificially Synthesized Peptide
PGLEEAQFWL

SEQ ID NO: 1188 - protein, 10 aa, Artificial Sequence
  Artificially Synthesized Peptide
IQFDACLLQI

SEQ ID NO: 1189 - protein, 10 aa, Artificial Sequence
  Artificially Synthesized Peptide
VPPVLNPIVY

SEQ ID NO: 1190 - protein, 10 aa, Artificial Sequence
  Artificially Synthesized Peptide
VNVVYGLIVI

SEQ ID NO: 1191 - protein, 10 aa, Artificial Sequence
  Artificially Synthesized Peptide
VLGNLTIIYI

SEQ ID NO: 1192 - protein, 10 aa, Artificial Sequence
  Artificially Synthesized Peptide
RFSKRRDSPL

SEQ ID NO: 1193 - protein, 10 aa, Artificial Sequence
  Artificially Synthesized Peptide
LIAVLGNLTI

SEQ ID NO: 1194 - protein, 10 aa, Artificial Sequence
  Artificially Synthesized Peptide
LLVPPVLNPI

SEQ ID NO: 1195 - protein, 10 aa, Artificial Sequence
  Artificially Synthesized Peptide
IYIVRTEHSL

SEQ ID NO: 1196 - protein, 10 aa, Artificial Sequence
  Artificially Synthesized Peptide
YFILIGLPGL

SEQ ID NO: 1197 - protein, 10 aa, Artificial Sequence
  Artificially Synthesized Peptide
YIFLCMLSGI

SEQ ID NO: 1198 - protein, 10 aa, Artificial Sequence
  Artificially Synthesized Peptide
FLCMLSGIDI

SEQ ID NO: 1199 - protein, 10 aa, Artificial Sequence
  Artificially Synthesized Peptide
LPVFIKQLPF

SEQ ID NO: 1200 - protein, 10 aa, Artificial Sequence
  Artificially Synthesized Peptide
VRGAALMAPL

SEQ ID NO: 1201 - protein, 9 aa, Artificial Sequence
  Artificially Synthesized Peptide
LPVILANIY

SEQ ID NO: 1202 - protein, 9 aa, Artificial Sequence
  Artificially Synthesized Peptide
EPMYIFLCM

SEQ ID NO: 1203 - protein, 9 aa, Artificial Sequence
  Artificially Synthesized Peptide
LPGLEEAQF

SEQ ID NO: 1204 - protein, 9 aa, Artificial Sequence
  Artificially Synthesized Peptide
MPKMLAIFW

SEQ ID NO: 1205 - protein, 9 aa, Artificial Sequence
  Artificially Synthesized Peptide
HPLRHATVL

SEQ ID NO: 1206 - protein, 9 aa, Artificial Sequence
  Artificially Synthesized Peptide
RSNILSHSY

SEQ ID NO: 1207 - protein, 9 aa, Artificial Sequence
  Artificially Synthesized Peptide
LPFCRSNIL

SEQ ID NO: 1208 - protein, 9 aa, Artificial Sequence
  Artificially Synthesized Peptide
FSKRRDSPL

SEQ ID NO: 1209 - protein, 9 aa, Artificial Sequence
  Artificially Synthesized Peptide
LPRVTKIGV

SEQ ID NO: 1210 - protein, 9 aa, Artificial Sequence
  Artificially Synthesized Peptide
DSLLISFSY

SEQ ID NO: 1211 - protein, 9 aa, Artificial Sequence
  Artificially Synthesized Peptide
ISTSSMPKM

SEQ ID NO: 1212 - protein, 9 aa, Artificial Sequence
  Artificially Synthesized Peptide
FPLCSLYLI

SEQ ID NO: 1213 - protein, 9 aa, Artificial Sequence
  Artificially Synthesized Peptide
LSGMESTVL

SEQ ID NO: 1214 - protein, 9 aa, Artificial Sequence
  Artificially Synthesized Peptide
LAFPLCSLY

SEQ ID NO: 1215 - protein, 9 aa, Artificial Sequence
  Artificially Synthesized Peptide
FAIHSLSGM

SEQ ID NO: 1216 - protein, 9 aa, Artificial Sequence
  Artificially Synthesized Peptide
CSLYLIAVL

SEQ ID NO: 1217 - protein, 9 aa, Artificial Sequence
  Artificially Synthesized Peptide
ESSATYFIL

SEQ ID NO: 1218 - protein, 9 aa, Artificial Sequence
  Artificially Synthesized Peptide
ISAIGLDSL

SEQ ID NO: 1219 - protein, 9 aa, Artificial Sequence
  Artificially Synthesized Peptide
ISFSYLLIL

SEQ ID NO: 1220 - protein, 9 aa, Artificial Sequence
  Artificially Synthesized Peptide
KTKEIRQRI

SEQ ID NO: 1221 - protein, 9 aa, Artificial Sequence
  Artificially Synthesized Peptide
VPPVLNPIV

SEQ ID NO: 1222 - protein, 9 aa, Artificial Sequence
  Artificially Synthesized Peptide
NGNESSATY

SEQ ID NO: 1223 - protein, 9 aa, Artificial Sequence
  Artificially Synthesized Peptide
VPFIGLSMV

SEQ ID NO: 1224 - protein, 9 aa, Artificial Sequence
  Artificially Synthesized Peptide
PPVLNPIVY

SEQ ID NO: 1225 - protein, 9 aa, Artificial Sequence
  Artificially Synthesized Peptide
EIRQRILRL

SEQ ID NO: 1226 - protein, 9 aa, Artificial Sequence
  Artificially Synthesized Peptide
HSLHEPMYI

SEQ ID NO: 1227 - protein, 9 aa, Artificial Sequence
  Artificially Synthesized Peptide
AAVVRGAAL

SEQ ID NO: 1228 - protein, 9 aa, Artificial Sequence
  Artificially Synthesized Peptide
SAIGLDSLL

SEQ ID NO: 1229 - protein, 9 aa, Artificial Sequence
  Artificially Synthesized Peptide
MAFDRYVAI

SEQ ID NO: 1230 - protein, 9 aa, Artificial Sequence
  Artificially Synthesized Peptide
SGMESTVLL

SEQ ID NO: 1231 - protein, 9 aa, Artificial Sequence
  Artificially Synthesized Peptide
AVVRGAALM

SEQ ID NO: 1232 - protein, 9 aa, Artificial Sequence
  Artificially Synthesized Peptide
SLHEPMYIF

SEQ ID NO: 1233 - protein, 9 aa, Artificial Sequence
  Artificially Synthesized Peptide
SSMPKMLAI

SEQ ID NO: 1234 - protein, 9 aa, Artificial Sequence
  Artificially Synthesized Peptide
LLAMAFDRY

SEQ ID NO: 1235 - protein, 9 aa, Artificial Sequence
  Artificially Synthesized Peptide
HVCAVFIFY

SEQ ID NO: 1236 - protein, 9 aa, Artificial Sequence
  Artificially Synthesized Peptide
VSHVCAVFI

SEQ ID NO: 1237 - protein, 9 aa, Artificial Sequence
  Artificially Synthesized Peptide
VLGNLTIIY

SEQ ID NO: 1238 - protein, 9 aa, Artificial Sequence
  Artificially Synthesized Peptide
SPLPVILAN

SEQ ID NO: 1239 - protein, 9 aa, Artificial Sequence
  Artificially Synthesized Peptide
DPNGNESSA

SEQ ID NO: 1240 - protein, 9 aa, Artificial Sequence
  Artificially Synthesized Peptide
DILISTSSM

SEQ ID NO: 1241 - protein, 9 aa, Artificial Sequence
  Artificially Synthesized Peptide
RGAALMAPL

SEQ ID NO: 1242 - protein, 9 aa, Artificial Sequence
  Artificially Synthesized Peptide
YVPFIGLSM

SEQ ID NO: 1243 - protein, 9 aa, Artificial Sequence
  Artificially Synthesized Peptide
SSATYFILI

SEQ ID NO: 1244 - protein, 9 aa, Artificial Sequence
  Artificially Synthesized Peptide
NPIVYGVKT

SEQ ID NO: 1245 - protein, 9 aa, Artificial Sequence
  Artificially Synthesized Peptide
QAKAFGTCV

SEQ ID NO: 1246 - protein, 9 aa, Artificial Sequence
  Artificially Synthesized Peptide
CLHQDVMKL

SEQ ID NO: 1247 - protein, 9 aa, Artificial Sequence
  Artificially Synthesized Peptide
TIQFDACLL

SEQ ID NO: 1248 - protein, 9 aa, Artificial Sequence
  Artificially Synthesized Peptide
IAVLGNLTI

SEQ ID NO: 1249 - protein, 9 aa, Artificial Sequence
  Artificially Synthesized Peptide
VMKLACDDI

SEQ ID NO: 1250 - protein, 9 aa, Artificial Sequence
  Artificially Synthesized Peptide
VILANIYLL

SEQ ID NO: 1251 - protein, 9 aa, Artificial Sequence
  Artificially Synthesized Peptide
CMLSGIDIL

SEQ ID NO: 1252 - protein, 9 aa, Artificial Sequence
  Artificially Synthesized Peptide
YIVRTEHSL

SEQ ID NO: 1253 - protein, 9 aa, Artificial Sequence
  Artificially Synthesized Peptide
CVSHVCAVF

SEQ ID NO: 1254 - protein, 9 aa, Artificial Sequence
  Artificially Synthesized Peptide
IVIISAIGL

SEQ ID NO: 1255 - protein, 9 aa, Artificial Sequence
  Artificially Synthesized Peptide
FILIGLPGL

SEQ ID NO: 1256 - protein, 9 aa, Artificial Sequence
  Artificially Synthesized Peptide
LILKTVLGL

SEQ ID NO: 1257 - protein, 9 aa, Artificial Sequence
  Artificially Synthesized Peptide
AQFWLAFPL

SEQ ID NO: 1258 - protein, 9 aa, Artificial Sequence
  Artificially Synthesized Peptide
LLISFSYLL

SEQ ID NO: 1259 - protein, 9 aa, Artificial Sequence
  Artificially Synthesized Peptide
STVLLAMAF

SEQ ID NO: 1260 - protein, 9 aa, Artificial Sequence
  Artificially Synthesized Peptide
LQIFAIHSL

SEQ ID NO: 1261 - protein, 9 aa, Artificial Sequence
  Artificially Synthesized Peptide
TTIQFDACL

SEQ ID NO: 1262 - protein, 9 aa, Artificial Sequence
  Artificially Synthesized Peptide
IGLSMVHRF

SEQ ID NO: 1263 - protein, 9 aa, Artificial Sequence
  Artificially Synthesized Peptide
WLAFPLCSL

SEQ ID NO: 1264 - protein, 9 aa, Artificial Sequence
  Artificially Synthesized Peptide
SMPKMLAIF

SEQ ID NO: 1265 - protein, 9 aa, Artificial Sequence
  Artificially Synthesized Peptide
HSYCLHQDV

SEQ ID NO: 1266 - protein, 9 aa, Artificial Sequence
  Artificially Synthesized Peptide
YLIAVLGNL

SEQ ID NO: 1267 - protein, 9 aa, Artificial Sequence
  Artificially Synthesized Peptide
NILSHSYCL

SEQ ID NO: 1268 - protein, 9 aa, Artificial Sequence
  Artificially Synthesized Peptide
ALMAPLPVF

SEQ ID NO: 1269 - protein, 9 aa, Artificial Sequence
  Artificially Synthesized Peptide
SLLISFSYL

SEQ ID NO: 1270 - protein, 9 aa, Artificial Sequence
  Artificially Synthesized Peptide
YLLILKTVL

SEQ ID NO: 1271 - protein, 9 aa, Artificial Sequence
  Artificially Synthesized Peptide
AVFIFYVPF

SEQ ID NO: 1272 - protein, 9 aa, Artificial Sequence
  Artificially Synthesized Peptide
STSSMPKML

SEQ ID NO: 1273 - protein, 9 aa, Artificial Sequence
  Artificially Synthesized Peptide
ATYFILIGL

SEQ ID NO: 1274 - protein, 9 aa, Artificial Sequence
  Artificially Synthesized Peptide
LACDDIRVN

SEQ ID NO: 1275 - protein, 9 aa, Artificial Sequence
  Artificially Synthesized Peptide
RVNVVYGLI

SEQ ID NO: 1276 - protein, 9 aa, Artificial Sequence
  Artificially Synthesized Peptide
LSGIDILIS

SEQ ID NO: 1277 - protein, 9 aa, Artificial Sequence
  Artificially Synthesized Peptide
LAMAFDRYV

SEQ ID NO: 1278 - protein, 9 aa, Artificial Sequence
  Artificially Synthesized Peptide
VTKIGVAAV

SEQ ID NO: 1279 - protein, 9 aa, Artificial Sequence
  Artificially Synthesized Peptide
GLEEAQFWL

SEQ ID NO: 1280 - protein, 9 aa, Artificial Sequence
  Artificially Synthesized Peptide
KLACDDIRV

SEQ ID NO: 1281 - protein, 9 aa, Artificial Sequence
  Artificially Synthesized Peptide
AIGLDSLLI

SEQ ID NO: 1282 - protein, 9 aa, Artificial Sequence
  Artificially Synthesized Peptide
AALMAPLPV

SEQ ID NO: 1283 - protein, 9 aa, Artificial Sequence
  Artificially Synthesized Peptide
LTREAQAKA

SEQ ID NO: 1284 - protein, 9 aa, Artificial Sequence
  Artificially Synthesized Peptide
ESTVLLAMA

SEQ ID NO: 1285 - protein, 9 aa, Artificial Sequence
  Artificially Synthesized Peptide
NSTTIQFDA

SEQ ID NO: 1286 - protein, 9 aa, Artificial Sequence
  Artificially Synthesized Peptide
FSYLLILKT

SEQ ID NO: 1287 - protein, 9 aa, Artificial Sequence
  Artificially Synthesized Peptide
TSSMPKMLA

SEQ ID NO: 1288 - protein, 9 aa, Artificial Sequence
  Artificially Synthesized Peptide
HSLSGMEST

SEQ ID NO: 1289 - protein, 9 aa, Artificial Sequence
  Artificially Synthesized Peptide
DSPLPVILA

SEQ ID NO: 1290 - protein, 9 aa, Artificial Sequence
  Artificially Synthesized Peptide
QLPFCRSNI

SEQ ID NO: 1291 - protein, 9 aa, Artificial Sequence
  Artificially Synthesized Peptide
VVYGLIVII

SEQ ID NO: 1292 - protein, 9 aa, Artificial Sequence
  Artificially Synthesized Peptide
GLIVIISAI

SEQ ID NO: 1293 - protein, 9 aa, Artificial Sequence
  Artificially Synthesized Peptide
NVVYGLIVI

SEQ ID NO: 1294 - protein, 9 aa, Artificial Sequence
  Artificially Synthesized Peptide
ACLLQIFAI

SEQ ID NO: 1295 - protein, 9 aa, Artificial Sequence
  Artificially Synthesized Peptide
MLSGIDILI

SEQ ID NO: 1296 - protein, 9 aa, Artificial Sequence
  Artificially Synthesized Peptide
LTLPRVTKI

SEQ ID NO: 1297 - protein, 9 aa, Artificial Sequence
  Artificially Synthesized Peptide
LMAPLPVFI

SEQ ID NO: 1298 - protein, 9 aa, Artificial Sequence
  Artificially Synthesized Peptide
LVPPVLNPI

SEQ ID NO: 1299 - protein, 9 aa, Artificial Sequence
  Artificially Synthesized Peptide
AVLGNLTII

SEQ ID NO: 1300 - protein, 9 aa, Artificial Sequence
  Artificially Synthesized Peptide
LISFSYLLI

SEQ ID NO: 1301 - protein, 10 aa, Artificial Sequence
  Artificially Synthesized Peptide
MPKMLAIFWF

SEQ ID NO: 1302 - protein, 10 aa, Artificial Sequence
  Artificially Synthesized Peptide
VPPVLNPIVY

SEQ ID NO: 1303 - protein, 10 aa, Artificial Sequence
  Artificially Synthesized Peptide
LPVILANIYL

SEQ ID NO: 1304 - protein, 10 aa, Artificial Sequence
  Artificially Synthesized Peptide
APLPVFIKQL

SEQ ID NO: 1305 - protein, 10 aa, Artificial Sequence
  Artificially Synthesized Peptide
EPMYIFLCML

SEQ ID NO: 1306 - protein, 10 aa, Artificial Sequence
  Artificially Synthesized Peptide
LPVFIKQLPF

SEQ ID NO: 1307 - protein, 10 aa, Artificial Sequence
  Artificially Synthesized Peptide
LPGLEEAQFW

SEQ ID NO: 1308 - protein, 10 aa, Artificial Sequence
  Artificially Synthesized Peptide
KTKEIRQRIL

SEQ ID NO: 1309 - protein, 10 aa, Artificial Sequence
  Artificially Synthesized Peptide
HSYCLHQDVM

SEQ ID NO: 1310 - protein, 10 aa, Artificial Sequence
  Artificially Synthesized Peptide
SPLPVILANI

SEQ ID NO: 1311 - protein, 10 aa, Artificial Sequence
  Artificially Synthesized Peptide
LPRVTKIGVA

SEQ ID NO: 1312 - protein, 10 aa, Artificial Sequence
  Artificially Synthesized Peptide
LTREAQAKAF

SEQ ID NO: 1313 - protein, 10 aa, Artificial Sequence
  Artificially Synthesized Peptide
AAVVRGAALM

SEQ ID NO: 1314 - protein, 10 aa, Artificial Sequence
  Artificially Synthesized Peptide
ISAIGLDSLL

SEQ ID NO: 1315 - protein, 10 aa, Artificial Sequence
  Artificially Synthesized Peptide
ISTSSMPKML

SEQ ID NO: 1316 - protein, 10 aa, Artificial Sequence
  Artificially Synthesized Peptide
VSHVCAVFIF

SEQ ID NO: 1317 - protein, 10 aa, Artificial Sequence
  Artificially Synthesized Peptide
DSLLISFSYL

SEQ ID NO: 1318 - protein, 10 aa, Artificial Sequence
  Artificially Synthesized Peptide
ESTVLLAMAF

SEQ ID NO: 1319 - protein, 10 aa, Artificial Sequence
  Artificially Synthesized Peptide
SSMPKMLAIF

SEQ ID NO: 1320 - protein, 10 aa, Artificial Sequence
  Artificially Synthesized Peptide
HSLHEPMYIF

SEQ ID NO: 1321 - protein, 10 aa, Artificial Sequence
  Artificially Synthesized Peptide
LSGMESTVLL

SEQ ID NO: 1322 - protein, 10 aa, Artificial Sequence
  Artificially Synthesized Peptide
SATYFILIGL

SEQ ID NO: 1323 - protein, 10 aa, Artificial Sequence
  Artificially Synthesized Peptide
DIRVNVVYGL

SEQ ID NO: 1324 - protein, 10 aa, Artificial Sequence
  Artificially Synthesized Peptide
AALMAPLPVF

SEQ ID NO: 1325 - protein, 10 aa, Artificial Sequence
  Artificially Synthesized Peptide
EIRQRILRLF

SEQ ID NO: 1326 - protein, 10 aa, Artificial Sequence
  Artificially Synthesized Peptide
DPNGNESSAT

SEQ ID NO: 1327 - protein, 10 aa, Artificial Sequence
  Artificially Synthesized Peptide
VAAVVRGAAL

SEQ ID NO: 1328 - protein, 10 aa, Artificial Sequence
  Artificially Synthesized Peptide
LAFPLCSLYL

SEQ ID NO: 1329 - protein, 10 aa, Artificial Sequence
  Artificially Synthesized Peptide
EAQFWLAFPL

SEQ ID NO: 1330 - protein, 10 aa, Artificial Sequence
  Artificially Synthesized Peptide
CAVFIFYVPF

SEQ ID NO: 1331 - protein, 10 aa, Artificial Sequence
  Artificially Synthesized Peptide
SLHEPMYIFL

SEQ ID NO: 1332 - protein, 10 aa, Artificial Sequence
  Artificially Synthesized Peptide
LISTSSMPKM

SEQ ID NO: 1333 - protein, 10 aa, Artificial Sequence
  Artificially Synthesized Peptide
HPLRHATVLT

SEQ ID NO: 1334 - protein, 10 aa, Artificial Sequence
  Artificially Synthesized Peptide
TSSMPKMLAI

SEQ ID NO: 1335 - protein, 10 aa, Artificial Sequence
  Artificially Synthesized Peptide
NGNESSATYF

SEQ ID NO: 1336 - protein, 10 aa, Artificial Sequence
  Artificially Synthesized Peptide
VLLAMAFDRY

SEQ ID NO: 1337 - protein, 10 aa, Artificial Sequence
  Artificially Synthesized Peptide
WLAFPLCSLY

SEQ ID NO: 1338 - protein, 10 aa, Artificial Sequence
  Artificially Synthesized Peptide
FPLCSLYLIA

SEQ ID NO: 1339 - protein, 10 aa, Artificial Sequence
  Artificially Synthesized Peptide
LPFCRSNILS

SEQ ID NO: 1340 - protein, 10 aa, Artificial Sequence
  Artificially Synthesized Peptide
ESSATYFILI

SEQ ID NO: 1341 - protein, 10 aa, Artificial Sequence
  Artificially Synthesized Peptide
AVLGNLTIIY

SEQ ID NO: 1342 - protein, 10 aa, Artificial Sequence
  Artificially Synthesized Peptide
IGLDSLLISF

SEQ ID NO: 1343 - protein, 10 aa, Artificial Sequence
  Artificially Synthesized Peptide
SAIGLDSLLI

SEQ ID NO: 1344 - protein, 10 aa, Artificial Sequence
  Artificially Synthesized Peptide
GLPGLEEAQF

SEQ ID NO: 1345 - protein, 10 aa, Artificial Sequence
  Artificially Synthesized Peptide
SLSGMESTVL

SEQ ID NO: 1346 - protein, 10 aa, Artificial Sequence
  Artificially Synthesized Peptide
YCLHQDVMKL

SEQ ID NO: 1347 - protein, 10 aa, Artificial Sequence
  Artificially Synthesized Peptide
TTIQFDACLL

SEQ ID NO: 1348 - protein, 10 aa, Artificial Sequence
  Artificially Synthesized Peptide
KAFGTCVSHV

SEQ ID NO: 1349 - protein, 10 aa, Artificial Sequence
  Artificially Synthesized Peptide
DACLLQIFAI

SEQ ID NO: 1350 - protein, 10 aa, Artificial Sequence
  Artificially Synthesized Peptide
IAVLGNLTII

SEQ ID NO: 1351 - protein, 10 aa, Artificial Sequence
  Artificially Synthesized Peptide
RQRILRLFHV

SEQ ID NO: 1352 - protein, 10 aa, Artificial Sequence
  Artificially Synthesized Peptide
RTEHSLHEPM

SEQ ID NO: 1353 - protein, 10 aa, Artificial Sequence
  Artificially Synthesized Peptide
LACDDIRVNV

SEQ ID NO: 1354 - protein, 10 aa, Artificial Sequence
  Artificially Synthesized Peptide
FSYLLILKTV

SEQ ID NO: 1355 - protein, 10 aa, Artificial Sequence
  Artificially Synthesized Peptide
TCVSHVCAVF

SEQ ID NO: 1356 - protein, 10 aa, Artificial Sequence
  Artificially Synthesized Peptide
LISFSYLLIL

SEQ ID NO: 1357 - protein, 10 aa, Artificial Sequence
  Artificially Synthesized Peptide
LCSLYLIAVL

SEQ ID NO: 1358 - protein, 10 aa, Artificial Sequence
  Artificially Synthesized Peptide
LIVIISAIGL

SEQ ID NO: 1359 - protein, 10 aa, Artificial Sequence
  Artificially Synthesized Peptide
LLILKTVLGL

SEQ ID NO: 1360 - protein, 10 aa, Artificial Sequence
  Artificially Synthesized Peptide
RSNILSHSYC

SEQ ID NO: 1361 - protein, 10 aa, Artificial Sequence
  Artificially Synthesized Peptide
LLQIFAIHSL

SEQ ID NO: 1362 - protein, 10 aa, Artificial Sequence
  Artificially Synthesized Peptide
SNILSHSYCL

SEQ ID NO: 1363 - protein, 10 aa, Artificial Sequence
  Artificially Synthesized Peptide
NIYLLVPPVL

SEQ ID NO: 1364 - protein, 10 aa, Artificial Sequence
  Artificially Synthesized Peptide
HSLSGMESTV

SEQ ID NO: 1365 - protein, 10 aa, Artificial Sequence
  Artificially Synthesized Peptide
LCMLSGIDIL

SEQ ID NO: 1366 - protein, 10 aa, Artificial Sequence
  Artificially Synthesized Peptide
IISAIGLDSL

SEQ ID NO: 1367 - protein, 10 aa, Artificial Sequence
  Artificially Synthesized Peptide
STTIQFDACL

SEQ ID NO: 1368 - protein, 10 aa, Artificial Sequence
  Artificially Synthesized Peptide
FIFYVPFIGL

SEQ ID NO: 1369 - protein, 10 aa, Artificial Sequence
  Artificially Synthesized Peptide
SLLISFSYLL

SEQ ID NO: 1370 - protein, 10 aa, Artificial Sequence
  Artificially Synthesized Peptide
FIGLSMVHRF

SEQ ID NO: 1371 - protein, 10 aa, Artificial Sequence
  Artificially Synthesized Peptide
QLPFCRSNIL

SEQ ID NO: 1372 - protein, 10 aa, Artificial Sequence
  Artificially Synthesized Peptide
QAKAFGTCVS

SEQ ID NO: 1373 - protein, 10 aa, Artificial Sequence
  Artificially Synthesized Peptide
IQFDACLLQI

SEQ ID NO: 1374 - protein, 10 aa, Artificial Sequence
  Artificially Synthesized Peptide
KQLPFCRSNI

SEQ ID NO: 1375 - protein, 10 aa, Artificial Sequence
  Artificially Synthesized Peptide
HATVLTLPRV

SEQ ID NO: 1376 - protein, 10 aa, Artificial Sequence
  Artificially Synthesized Peptide
GMESTVLLAM

SEQ ID NO: 1377 - protein, 10 aa, Artificial Sequence
  Artificially Synthesized Peptide
GAALMAPLPV

SEQ ID NO: 1378 - protein, 10 aa, Artificial Sequence
  Artificially Synthesized Peptide
VTKIGVAAVV

SEQ ID NO: 1379 - protein, 10 aa, Artificial Sequence
  Artificially Synthesized Peptide
MAFDRYVAIC

SEQ ID NO: 1380 - protein, 10 aa, Artificial Sequence
  Artificially Synthesized Peptide
LSGIDILIST

SEQ ID NO: 1381 - protein, 10 aa, Artificial Sequence
  Artificially Synthesized Peptide
NSTTIQFDAC

SEQ ID NO: 1382 - protein, 10 aa, Artificial Sequence
  Artificially Synthesized Peptide
SMPKMLAIFW

SEQ ID NO: 1383 - protein, 10 aa, Artificial Sequence
  Artificially Synthesized Peptide
DSPLPVILAN

SEQ ID NO: 1384 - protein, 10 aa, Artificial Sequence
  Artificially Synthesized Peptide
KRRDSPLPVI

SEQ ID NO: 1385 - protein, 10 aa, Artificial Sequence
  Artificially Synthesized Peptide
LAMAFDRYVA

SEQ ID NO: 1386 - protein, 10 aa, Artificial Sequence
  Artificially Synthesized Peptide
IVYGVKTKEI

SEQ ID NO: 1387 - protein, 10 aa, Artificial Sequence
  Artificially Synthesized Peptide
LLVPPVLNPI

SEQ ID NO: 1388 - protein, 10 aa, Artificial Sequence
  Artificially Synthesized Peptide
CVSHVCAVFI

SEQ ID NO: 1389 - protein, 10 aa, Artificial Sequence
  Artificially Synthesized Peptide
FLCMLSGIDI

SEQ ID NO: 1390 - protein, 10 aa, Artificial Sequence
  Artificially Synthesized Peptide
AIFWFNSTTI

SEQ ID NO: 1391 - protein, 10 aa, Artificial Sequence
  Artificially Synthesized Peptide
RVTKIGVAAV

SEQ ID NO: 1392 - protein, 10 aa, Artificial Sequence
  Artificially Synthesized Peptide
VLTLPRVTKI

SEQ ID NO: 1393 - protein, 10 aa, Artificial Sequence
  Artificially Synthesized Peptide
LIAVLGNLTI

SEQ ID NO: 1394 - protein, 10 aa, Artificial Sequence
  Artificially Synthesized Peptide
YIFLCMLSGI

SEQ ID NO: 1395 - protein, 10 aa, Artificial Sequence
  Artificially Synthesized Peptide
LLISFSYLLI

SEQ ID NO: 1396 - protein, 10 aa, Artificial Sequence
  Artificially Synthesized Peptide
ALMAPLPVFI

SEQ ID NO: 1397 - protein, 10 aa, Artificial Sequence
  Artificially Synthesized Peptide
VLGNLTIIYI

SEQ ID NO: 1398 - protein, 10 aa, Artificial Sequence
  Artificially Synthesized Peptide
VNVVYGLIVI

SEQ ID NO: 1399 - protein, 10 aa, Artificial Sequence
  Artificially Synthesized Peptide
AVFIFYVPFI

SEQ ID NO: 1400 - protein, 10 aa, Artificial Sequence
  Artificially Synthesized Peptide
YGLIVIISAI

SEQ ID NO: 1401 - DNA, 999 bp, Homo Sapiens
  misc_feature 175, 225, 229, 236, 241, 249, 268, 284, 292, 301, 306, 336,355, 360, 416, 430, 443, 475, 476, 482, 494, 503, 504, 506,524, 525, 531, 532, 534, 548, 554, 559, 561, 569, 574, 576,590, 591, 594, 612, 620, 621, 622, 636, 648, 657, 660: n = A,T,C or G
  misc_feature 673, 674, 685, 695, 698, 708, 710, 712, 722, 739, 747, 751,752, 760, 764, 767, 776, 778, 787, 789, 790, 792, 793, 794,797, 807, 817, 819, 823, 824, 830, 839, 840, 841, 845, 849,850, 853, 856, 857, 865, 866, 869, 871, 879, 882, 892: n = A,T,C or G
  misc_feature 893, 894, 896, 902, 903, 904, 916, 917, 925, 930, 939, 944,965, 969, 970, 977, 978, 979, 981, 982, 984, 992, 998: n = A,T,C or G
cacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggcctcccattgtgctccctctanctatgctgtgctagtaattgacaatcatctacatgtgcggacgagcacgncgcngagcccngtatnattctgcngcttcagcatgacaccctncagtctcagccaaagngcatctcngtcaatcanacacntgagctgtcgtacgagttgcatcatcctanggcaggatcaatgtgcggnaggcntgacgcagtgcacgtaccatggcagcaagacagggccggtacaaatgggggcgagncggggtgaagatgnaccctcgggtcanagagtgcctctgcgccaaaacctccatcatgnnaacagngtataacggcgnagaatcggnnangcgcaaggctaaggaaanncccaanncnggtactttaacccngcaaanggcancnaaacgggngggtnantgaacaaggaaggnntgnaactgggccaaaacgggntgggcaannnaaggactcatgggnccaagggacggnaaaaggggnaancggggcgaaatgnnaaaaaccgggncccggggaanaangaaggggaanangngtgaaggacngggttcaagggaaaagnaaaaccangggnnagaaaccnttcnaanggcccgggnangaaaggaantnngnnnggngaaaaaatcnaaaaaaagcngnggcnnaaaaanggggggaannnaaanaccnnggncgnnaaaaaacnnaangnggggggantanacacggaaannnangggcgnnnaagggaaataanncgggaacnaaagngcaaaccgnacggnaggaacgaaacccaccggagncgcnnaacgccnnncnnancccgagcngaggtng

SEQ ID NO: 1402 - DNA, 223 bp, Homo Sapiens
cacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggac

SEQ ID NO: 1403 - DNA, 217 bp, Homo Sapiens
  misc_feature 175: n = A,T,C or G
cacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggcctcccattgtgctccctctanctatgctgtgctagtaattgacaatcatctacatgtgcggac

SEQ ID NO: 1404 - protein, 51 aa, Homo Sapiens
HSFHTVEPLPAWCWSQFSFFMMVDPNGNESSATYFILIGLPGLEEAQFWLA

SEQ ID NO: 1405 - protein, 51 aa, Homo Sapiens; identical to SEQ ID NO: 1404

SEQ ID NO: 1406 - protein, 322 aa, Homo Sapiens
  VARIANT 55, 71, 73, 75, 83, 88, 91, 94, 104, 111, 130, 135, 139,150, 152, 156, 159, 160, 166, 168, 169, 174, 176, 178, 181,183, 187, 188, 197, 198, 210, 215, 219, 222, 223, 226, 227,228, 231, 237, 239, 241, 244, 245, 246, 249, 250, 253: Xaa = Any Amino Acid
  VARIANT 254, 255, 256, 263, 265, 267, 270, 271, 272, 274, 275, 276,279, 280, 281, 283, 284, 288, 289, 291, 292, 295, 298, 299,304, 311, 313, 315, 316, 317, 320, 322: Xaa = Any Amino Acid
HIPSIRLSLYLPGAGHSSASSWWIPMAMNPVLHTSSASLVKRLSSGWPPIVLPLXMLCLTIIYMCGRARRXAXYXSAASAHPXVSAKXHLXQSXTAVVRVASSXGRINVRXARSARTMAARQGRYKWGRXGVKMXPRVXECLCAKTSIMXTXYNGXESXXRKAKEXPXXGTLTXQXAXKRXGXTRKXXNWAKTGWAXXGLMGPRDGKRGXRGEMXKTGXRGXXKGXXXEGXGSREKXNXGXETXXXARXXKEXXXXKKSKKSXGXKXGGXXXPXXXKNXXXGXXTRKXXGXXGKXGNXXANRTXGTKPTGXAXRXXXPEXRX

SEQ ID NO: 1407 - protein, 327 aa, Homo Sapiens
  VARIANT 56, 72, 76, 77, 80, 92, 97, 99, 109, 117, 136, 139, 144,154, 155, 157, 161, 164, 165, 171, 173, 174, 178, 180, 181,182, 185, 187, 192, 193, 199, 202, 207, 211, 214, 215, 219,220, 227, 228, 231, 232, 236, 241, 244, 246, 250, 251: Xaa = Any Amino Acid
  VARIANT 254, 257, 258, 259, 260, 261, 264, 268, 270, 272, 275, 277,278, 281, 284, 285, 288, 289, 292, 293, 294, 296, 300, 301,305, 308, 310, 317, 318, 321, 322, 323, 326: Xaa = Any Amino Acid
TFLPYGASTCLVLVTVQLLHDGGSQWQIQCYILHPNRPPWFRRGSVLVGLPLCSLXLCCASNQSSTCADEHXAEPXXILXLQHDTLQSQPKXISVNXTXELSYELHHPXAGSMCGRXDAVHVPWQQDRAGTNGGEXGRXTLGSXSASAPKPPSXXQXITAXNRXXARLRKXPXXVLPXKXXXNGXVXEQGRXXTGPKRXGQXKDSWXQGTXKGXXGAKXXKPGPGEXXRGXXVKDXVQGKXKTXGXKPFXXPGXERXXXXXKNXKKAXAXKXGEXKXXGRXKTXXGGXXHGXXXAXKGNXXGTKXQTXRXERNPPEXXNAXXXPSXG

SEQ ID NO: 1408 - protein, 329 aa, Homo Sapiens
  VARIANT 58, 75, 76, 80, 83, 89, 94, 97, 100, 102, 112, 118, 120,138, 143, 147, 158, 160, 167, 172, 173, 175, 176, 182, 184,185, 189, 190, 195, 196, 202, 204, 205, 210, 214, 217, 218,222, 226, 229, 230, 234, 235, 243, 246, 247, 250, 252: Xaa = Any Amino Acid
  VARIANT 256, 259, 260, 261, 266, 269, 270, 271, 273, 276, 277, 278,280, 281, 282, 285, 286, 287, 290, 291, 294, 295, 298, 302,305, 307, 310, 318, 320, 323, 324, 325: Xaa = Any Amino Acid
HSFHTVEPLPAWCWSQFSFFMMVDPNGNESSATYFILIGLPGLEEAQFWLASHCAPSXYAVLVIDNHLHVRTSTXXSPVXFCXFSMTPXSLSQXASXSIXHXSCRTSCIILXQDQCAXGXTQCTYHGSKTGPVQMGAXRGEDXPSGXRVPLRQNLHHXNXVRRRIGXAQGGXXQXXYFNPAXGXXTGGXXNKEGXXLGQNGXGXXRTHGXKGRXKGXXGRNXKNRXPGXXEGEXXRTGFKGKXKPXXRNXSXGPGXKGXXXGEKIXKKXXXKXGGXXXTXXXKKXXXGGXXTEXXGRXREIXREXKXKPXGRNETHRXRXTPXXXRAEV

SEQ ID NO: 1409 - protein, 9 aa, Homo Sapiens
HVCAVFIFY

SEQ ID NO: 1410 - protein, 9 aa, Homo Sapiens
LAFPLCSLY

SEQ ID NO: 1411 - protein, 9 aa, Homo Sapiens
VLGNLTIIY

SEQ ID NO: 1412 - protein, 9 aa, Homo Sapiens
PPVLNPIVY

SEQ ID NO: 1413 - protein, 9 aa, Homo Sapiens
GMESTVLLA

SEQ ID NO: 1414 - protein, 9 aa, Homo Sapiens
LLAMAFDRY

SEQ ID NO: 1415 - protein, 9 aa, Homo Sapiens
RSNILSHSY

SEQ ID NO: 1416 - protein, 9 aa, Homo Sapiens
DDIRVNVVY

SEQ ID NO: 1417 - protein, 9 aa, Homo Sapiens
DSLLISFSY

SEQ ID NO: 1418 - protein, 9 aa, Homo Sapiens
LHEPMYIFL

SEQ ID NO: 1419 - protein, 9 aa, Homo Sapiens
LEEAQFWLA

SEQ ID NO: 1420 - protein, 9 aa, Homo Sapiens
SSATYFILI

SEQ ID NO: 1421 - protein, 9 aa, Homo Sapiens
RTEHSLHEP

SEQ ID NO: 1422 - protein, 9 aa, Homo Sapiens
EHSLHEPMY

SEQ ID NO: 1423 - protein, 9 aa, Homo Sapiens
SSMPKMLAI

SEQ ID NO: 1424 - protein, 9 aa, Homo Sapiens
QFDACLLQI

SEQ ID NO: 1425 - protein, 9 aa, Homo Sapiens
APLPVFIKQ

SEQ ID NO: 1426 - protein, 9 aa, Homo Sapiens
HQDVMKLAC

SEQ ID NO: 1427 - protein, 9 aa, Homo Sapiens
MVDPNGNES

SEQ ID NO: 1428 - protein, 9 aa, Homo Sapiens
NGNESSATY

SEQ ID NO: 1429 - protein, 9 aa, Homo Sapiens
GLDSLLISF

SEQ ID NO: 1430 - protein, 9 aa, Homo Sapiens
LPVILANIY

SEQ ID NO: 1431 - protein, 9 aa, Homo Sapiens
SPLPVILAN

SEQ ID NO: 1432 - protein, 9 aa, Homo Sapiens
STTIQFDAC

SEQ ID NO: 1433 - protein, 9 aa, Homo Sapiens
AFDRYVAIC

SEQ ID NO: 1434 - protein, 9 aa, Homo Sapiens
LTLPRVTKI

SEQ ID NO: 1435 - protein, 9 aa, Homo Sapiens
FSYLLILKT

SEQ ID NO: 1436 - protein, 9 aa, Homo Sapiens
LLVPPVLNP

SEQ ID NO: 1437 - protein, 9 aa, Homo Sapiens
ACDDIRVNV

SEQ ID NO: 1438 - protein, 9 aa, Homo Sapiens
CDDIRVNVV

SEQ ID NO: 1439 - protein, 9 aa, Homo Sapiens
TREAQAKAF

SEQ ID NO: 1440 - protein, 9 aa, Homo Sapiens
RRDSPLPVI

SEQ ID NO: 1441 - protein, 9 aa, Homo Sapiens
DSPLPVILA

SEQ ID NO: 1442 - protein, 9 aa, Homo Sapiens
VLNPIVYGV

SEQ ID NO: 1443 - protein, 9 aa, Homo Sapiens
FILIGLPGL

SEQ ID NO: 1444 - protein, 9 aa, Homo Sapiens
WLAFPLCSL

SEQ ID NO: 1445 - protein, 9 aa, Homo Sapiens
YLIAVLGNL

SEQ ID NO: 1446 - protein, 9 aa, Homo Sapiens
LILKTVLGL

SEQ ID NO: 1447 - protein, 9 aa, Homo Sapiens
CMLSGIDIL

SEQ ID NO: 1448 - protein, 9 aa, Homo Sapiens
SLSGMESTV

SEQ ID NO: 1449 - protein, 9 aa, Homo Sapiens
CLHQDVMKL

SEQ ID NO: 1450 - protein, 9 aa, Homo Sapiens
GLIVIISAI

SEQ ID NO: 1451 - protein, 9 aa, Homo Sapiens
LLISFSYLL

SEQ ID NO: 1452 - protein, 9 aa, Homo Sapiens
VILANIYLL

SEQ ID NO: 1453 - protein, 9 aa, Homo Sapiens
LMAPLPVFI

SEQ ID NO: 1454 - protein, 9 aa, Homo Sapiens
YLLILKTVL

SEQ ID NO: 1455 - protein, 9 aa, Homo Sapiens
ILANIYLLV

SEQ ID NO: 1456 - protein, 9 aa, Homo Sapiens
NIYLLVPPV

SEQ ID NO: 1457 - protein, 9 aa, Homo Sapiens
LTLPRVTKI

SEQ ID NO: 1458 - protein, 9 aa, Homo Sapiens
SLLISFSYL

SEQ ID NO: 1459 - protein, 9 aa, Homo Sapiens
YIVRTEHSL

SEQ ID NO: 1460 - protein, 9 aa, Homo Sapiens
VTKIGVAAV

SEQ ID NO: 1461 - protein, 9 aa, Homo Sapiens
KLACDDIRV

SEQ ID NO: 1462 - protein, 9 aa, Homo Sapiens
VVYGLIVII

SEQ ID NO: 1463 - protein, 9 aa, Homo Sapiens
GLEEAQFWL

SEQ ID NO: 1464 - protein, 9 aa, Homo Sapiens
AVLGNLTII

SEQ ID NO: 1465 - protein, 9 aa, Homo Sapiens
ISAIGLDSL

SEQ ID NO: 1466 - protein, 9 aa, Homo Sapiens
ATYFILIGL

SEQ ID NO: 1467 - protein, 9 aa, Homo Sapiens
PMYIFLCML

SEQ ID NO: 1468 - protein, 9 aa, Homo Sapiens
ATVLTLPRV

SEQ ID NO: 1469 - protein, 9 aa, Homo Sapiens
PLPVFIKQL

SEQ ID NO: 1470 - protein, 9 aa, Homo Sapiens
NILSHSYCL

SEQ ID NO: 1471 - protein, 9 aa, Homo Sapiens
SAIGLDSLL

SEQ ID NO: 1472 - protein, 9 aa, Homo Sapiens
PLPVILANI

SEQ ID NO: 1473 - protein, 9 aa, Homo Sapiens
LVPPVLNPI

SEQ ID NO: 1474 - protein, 9 aa, Homo Sapiens
MLSGIDILI

SEQ ID NO: 1475 - protein, 9 aa, Homo Sapiens
LQIFAIHSL

SEQ ID NO: 1476 - protein, 9 aa, Homo Sapiens
LLVPPVLNP

SEQ ID NO: 1477 - protein, 9 aa, Homo Sapiens
EIRQRILRL

SEQ ID NO: 1478 - protein, 9 aa, Homo Sapiens
ILRLFHVAT

SEQ ID NO: 1479 - protein, 9 aa, Homo Sapiens
IAVLGNLTI

SEQ ID NO: 1480 - protein, 9 aa, Homo Sapiens
LTIIYIVRT

SEQ ID NO: 1481 - protein, 9 aa, Homo Sapiens
TTIQFDACL

SEQ ID NO: 1482 - protein, 9 aa, Homo Sapiens
SGMESTVLL

SEQ ID NO: 1483 - protein, 9 aa, Homo Sapiens
AICHPLRHA

SEQ ID NO: 1484 - protein, 9 aa, Homo Sapiens
LRHATVLTL

SEQ ID NO: 1485 - protein, 9 aa, Homo Sapiens
AAVVRGAAL

SEQ ID NO: 1486 - protein, 9 aa, Homo Sapiens
AALMAPLPV

SEQ ID NO: 1487 - protein, 9 aa, Homo Sapiens
ALMAPLPVF

SEQ ID NO: 1488 - protein, 9 aa, Homo Sapiens
IVIISAIGL

SEQ ID NO: 1489 - protein, 9 aa, Homo Sapiens
AIGLDSLLI

SEQ ID NO: 1490 - protein, 9 aa, Homo Sapiens
ISFSYLLIL

SEQ ID NO: 1491 - protein, 9 aa, Homo Sapiens
SYLLILKTV

SEQ ID NO: 1492 - protein, 9 aa, Homo Sapiens
LLILKTVLG

SEQ ID NO: 1493 - protein, 9 aa, Homo Sapiens
ILKTVLGLT

SEQ ID NO: 1494 - protein, 9 aa, Homo Sapiens
IGLPGLEEA

SEQ ID NO: 1495 - protein, 9 aa, Homo Sapiens
LCSLYLIAV

SEQ ID NO: 1496 - protein, 9 aa, Homo Sapiens
CSLYLIAVL

SEQ ID NO: 1497 - protein, 9 aa, Homo Sapiens
LIAVLGNLT

SEQ ID NO: 1498 - protein, 9 aa, Homo Sapiens
GNLTIIYIV

SEQ ID NO: 1499 - protein, 9 aa, Homo Sapiens
AIFWFNSTT

SEQ ID NO: 1500 - protein, 9 aa, Homo Sapiens
LAMAFDRYV

SEQ ID NO: 1501 - protein, 9 aa, Homo Sapiens
IRVNVVYGL

SEQ ID NO: 1502 - protein, 9 aa, Homo Sapiens
GLDSLLISF

SEQ ID NO: 1503 - protein, 9 aa, Homo Sapiens
LISFSYLLI

SEQ ID NO: 1504 - protein, 9 aa, Homo Sapiens
VCAVFIFYV

SEQ ID NO: 1505 - protein, 9 aa, Homo Sapiens
VPFIGLSMV

SEQ ID NO: 1506 - protein, 9 aa, Homo Sapiens
ILIGLPGLE

SEQ ID NO: 1507 - protein, 9 aa, Homo Sapiens
IFLCMLSGI

SEQ ID NO: 1508 - protein, 9 aa, Homo Sapiens
DILISTSSM

SEQ ID NO: 1509 - protein, 9 aa, Homo Sapiens
TIQFDACLL

SEQ ID NO: 1510 - protein, 9 aa, Homo Sapiens
ACLLQIFAI

SEQ ID NO: 1511 - protein, 9 aa, Homo Sapiens
GMESTVLLA

SEQ ID NO: 1512 - protein, 9 aa, Homo Sapiens
MAFDRYVAI

SEQ ID NO: 1513 - protein, 9 aa, Homo Sapiens
QLPFCRSNI

SEQ ID NO: 1514 - protein, 9 aa, Homo Sapiens
NVVYGLIVI

SEQ ID NO: 1515 - protein, 9 aa, Homo Sapiens
TVLGLTREA

SEQ ID NO: 1516 - protein, 9 aa, Homo Sapiens
YLLVPPVLN

SEQ ID NO: 1517 - protein, 9 aa, Homo Sapiens
FPLCSLYLI

SEQ ID NO: 1518 - protein, 9 aa, Homo Sapiens
SLHEPMYIF

SEQ ID NO: 1519 - protein, 9 aa, Homo Sapiens
GIDILISTS

SEQ ID NO: 1520 - protein, 9 aa, Homo Sapiens
SSMPKMLAI

SEQ ID NO: 1521 - protein, 9 aa, Homo Sapiens
SMPKMLAIF

SEQ ID NO: 1522 - protein, 9 aa, Homo Sapiens
FAIHSLSGM

SEQ ID NO: 1523 - protein, 9 aa, Homo Sapiens
AMAFDRYVA

SEQ ID NO: 1524 - protein, 9 aa, Homo Sapiens
TKIGVAAVV

SEQ ID NO: 1525 - protein, 9 aa, Homo Sapiens
GVAAVVRGA

SEQ ID NO: 1526 - protein, 9 aa, Homo Sapiens
VMKLACDDI

SEQ ID NO: 1527 - protein, 9 aa, Homo Sapiens
LTREAQAKA

SEQ ID NO: 1528 - protein, 9 aa, Homo Sapiens
AFGTCVSHV

SEQ ID NO: 1529 - protein, 9 aa, Homo Sapiens
VFIFYVPFI

SEQ ID NO: 1530 - protein, 9 aa, Homo Sapiens
QRILRLFHV

SEQ ID NO: 1531 - protein, 9 aa, Homo Sapiens
RILRLFHVA

SEQ ID NO: 1532 - protein, 9 aa, Homo Sapiens
GLPGLEEAQ

SEQ ID NO: 1533 - protein, 9 aa, Homo Sapiens
SLYLIAVLG

SEQ ID NO: 1534 - protein, 9 aa, Homo Sapiens
LGNLTIIYI

SEQ ID NO: 1535 - protein, 9 aa, Homo Sapiens
TIIYIVRTE

SEQ ID NO: 1536 - protein, 9 aa, Homo Sapiens
SGIDILIST

SEQ ID NO: 1537 - protein, 9 aa, Homo Sapiens
STSSMPKML

SEQ ID NO: 1538 - protein, 9 aa, Homo Sapiens
PLRHATVLT

SEQ ID NO: 1539 - protein, 9 aa, Homo Sapiens
VLTLPRVTK

SEQ ID NO: 1540 - protein, 9 aa, Homo Sapiens
RGAALMAPL

SEQ ID NO: 1541 - protein, 9 aa, Homo Sapiens
ACDDIRVNV

SEQ ID NO: 1542 - protein, 9 aa, Homo Sapiens
CDDIRVNVV

SEQ ID NO: 1543 - protein, 9 aa, Homo Sapiens
VIISAIGLD

SEQ ID NO: 1544 - protein, 9 aa, Homo Sapiens
TCVSHVCAV

SEQ ID NO: 1545 - protein, 9 aa, Homo Sapiens
IFYVPFIGL

SEQ ID NO: 1546 - protein, 9 aa, Homo Sapiens
RDSPLPVIL

SEQ ID NO: 1547 - protein, 9 aa, Homo Sapiens
IYLLVPPVL

SEQ ID NO: 1548 - protein, 9 aa, Homo Sapiens
RLFHVATHA

SEQ ID NO: 1549 - protein, 9 aa, Homo Sapiens
VAAVVRGAA

SEQ ID NO: 1550 - protein, 9 aa, Homo Sapiens
AMAFDRYVA

SEQ ID NO: 1551 - protein, 9 aa, Homo Sapiens
GVAAVVRGA

SEQ ID NO: 1552 - protein, 9 aa, Homo Sapiens
DACLLQIFA

SEQ ID NO: 1553 - protein, 9 aa, Homo Sapiens
AICHPLRHA

SEQ ID NO: 1554 - protein, 9 aa, Homo Sapiens
DPNGNESSA

SEQ ID NO: 1555 - protein, 9 aa, Homo Sapiens
IGLPGLEEA

SEQ ID NO: 1556 - protein, 9 aa, Homo Sapiens
LEEAQFWLA

SEQ ID NO: 1557 - protein, 9 aa, Homo Sapiens
PLCSLYLIA

SEQ ID NO: 1558 - protein, 9 aa, Homo Sapiens
TSSMPKMLA

SEQ ID NO: 1559 - protein, 9 aa, Homo Sapiens
NSTTIQFDA

SEQ ID NO: 1560 - protein, 9 aa, Homo Sapiens
GMESTVLLA

SEQ ID NO: 1561 - protein, 9 aa, Homo Sapiens
ESTVLLAMA

SEQ ID NO: 1562 - protein, 9 aa, Homo Sapiens
PRVTKIGVA

SEQ ID NO: 1563 - protein, 9 aa, Homo Sapiens
RVTKIGVAA

SEQ ID NO: 1564 - protein, 9 aa, Homo Sapiens
VVRGAALMA

SEQ ID NO: 1565 - protein, 9 aa, Homo Sapiens
LHQDVMKLA

SEQ ID NO: 1566 - protein, 9 aa, Homo Sapiens
YGLIVIISA

SEQ ID NO: 1567 - protein, 9 aa, Homo Sapiens
TVLGLTREA

SEQ ID NO: 1568 - protein, 9 aa, Homo Sapiens
LGLTREAQA

SEQ ID NO: 1569 - protein, 9 aa, Homo Sapiens
LTREAQAKA

SEQ ID NO: 1570 - protein, 9 aa, Homo Sapiens
GTCVSHVCA

SEQ ID NO: 1571 - protein, 9 aa, Homo Sapiens
DSPLPVILA

SEQ ID NO: 1572 - protein, 9 aa, Homo Sapiens
RILRLFHVA

SEQ ID NO: 1573 - protein, 9 aa, Homo Sapiens
RLFHVATHA

SEQ ID NO: 1574 - protein, 9 aa, Homo Sapiens
EIRQRILRL

SEQ ID NO: 1575 - protein, 9 aa, Homo Sapiens
DILISTSSM

SEQ ID NO: 1576 - protein, 9 aa, Homo Sapiens
AVFIFYVPF

SEQ ID NO: 1577 - protein, 9 aa, Homo Sapiens
GLDSLLISF

SEQ ID NO: 1578 - protein, 9 aa, Homo Sapiens
FILIGLPGL

SEQ ID NO: 1579 - protein, 9 aa, Homo Sapiens
SLHEPMYIF

SEQ ID NO: 1580 - protein, 9 aa, Homo Sapiens
LLAMAFDRY

SEQ ID NO: 1581 - protein, 9 aa, Homo Sapiens
LILKTVLGL

SEQ ID NO: 1582 - protein, 9 aa, Homo Sapiens
HVCAVFIFY

SEQ ID NO: 1583 - protein, 9 aa, Homo Sapiens
ATYFILIGL

SEQ ID NO: 1584 - protein, 9 aa, Homo Sapiens
YLIAVLGNL

SEQ ID NO: 1585 - protein, 9 aa, Homo Sapiens
STVLLAMAF

SEQ ID NO: 1586 - protein, 9 aa, Homo Sapiens
ALMAPLPVF

SEQ ID NO: 1587 - protein, 9 aa, Homo Sapiens
PVFIKQLPF

SEQ ID NO: 1588 - protein, 9 aa, Homo Sapiens
CLHQDVMKL

SEQ ID NO: 1589 - protein, 9 aa, Homo Sapiens
WLAFPLCSL

SEQ ID NO: 1590 - protein, 9 aa, Homo Sapiens
TTIQFDACL

SEQ ID NO: 1591 - protein, 9 aa, Homo Sapiens
PLPVFIKQL

SEQ ID NO: 1592 - protein, 9 aa, Homo Sapiens
IVIISAIGL

SEQ ID NO: 1593 - protein, 9 aa, Homo Sapiens
SLLISFSYL

SEQ ID NO: 1594 - protein, 9 aa, Homo Sapiens
VILANIYLL

SEQ ID NO: 1595 - protein, 9 aa, Homo Sapiens
DIRVNVVYG

SEQ ID NO: 1596 - protein, 9 aa, Homo Sapiens
CVSHVCAVF

SEQ ID NO: 1597 - protein, 9 aa, Homo Sapiens
STSSMPKML

SEQ ID NO: 1598 - protein, 9 aa, Homo Sapiens
YVPFIGLSM

SEQ ID NO: 1599 - protein, 9 aa, Homo Sapiens
PVILANIYL

SEQ ID NO: 1600 - protein, 9 aa, Homo Sapiens
EEAQFWLAF

SEQ ID NO: 1601 - protein, 9 aa, Homo Sapiens
VLGNLTIIY

SEQ ID NO: 1602 - protein, 9 aa, Homo Sapiens
YIVRTEHSL

SEQ ID NO: 1603 - protein, 9 aa, Homo Sapiens
AVVRGAALM

SEQ ID NO: 1604 - protein, 9 aa, Homo Sapiens
NILSHSYCL

SEQ ID NO: 1605 - protein, 9 aa, Homo Sapiens
DDIRVNVVY

SEQ ID NO: 1606 - protein, 9 aa, Homo Sapiens
LLISFSYLL

SEQ ID NO: 1607 - protein, 9 aa, Homo Sapiens
IFYVPFIGL

SEQ ID NO: 1608 - protein, 9 aa, Homo Sapiens
ESSATYFIL

SEQ ID NO: 1609 - protein, 9 aa, Homo Sapiens
GLEEAQFWL

SEQ ID NO: 1610 - protein, 9 aa, Homo Sapiens
LTIIYIVRT

SEQ ID NO: 1611 - protein, 9 aa, Homo Sapiens
EHSLHEPMY

SEQ ID NO: 1612 - protein, 9 aa, Homo Sapiens
EPMYIFLCM

SEQ ID NO: 1613 - protein, 9 aa, Homo Sapiens
WFNSTTIQF

SEQ ID NO: 1614 - protein, 9 aa, Homo Sapiens
TIQFDACLL

SEQ ID NO: 1615 - protein, 9 aa, Homo Sapiens
DVMKLACDD

SEQ ID NO: 1616 - protein, 9 aa, Homo Sapiens
VVYGLIVII

SEQ ID NO: 1617 - protein, 9 aa, Homo Sapiens
YIFLCMLSG

SEQ ID NO: 1618 - protein, 9 aa, Homo Sapiens
GIDILISTS

SEQ ID NO: 1619 - protein, 9 aa, Homo Sapiens
SMPKMLAIF

SEQ ID NO: 1620 - protein, 9 aa, Homo Sapiens
FDACLLQIF

SEQ ID NO: 1621 - protein, 9 aa, Homo Sapiens
FAIHSLSGM

SEQ ID NO: 1622 - protein, 9 aa, Homo Sapiens
LTLPRVTKI

SEQ ID NO: 1623 - protein, 9 aa, Homo Sapiens
VTKIGVAAV

SEQ ID NO: 1624 - protein, 9 aa, Homo Sapiens
VIISAIGLD

SEQ ID NO: 1625 - protein, 9 aa, Homo Sapiens
DSLLISFSY

SEQ ID NO: 1626 - protein, 9 aa, Homo Sapiens
YLLILKTVL

SEQ ID NO: 1627 - protein, 9 aa, Homo Sapiens
FIGLSMVHR

SEQ ID NO: 1628 - protein, 9 aa, Homo Sapiens
LVPPVLNPI

SEQ ID NO: 1629 - protein, 9 aa, Homo Sapiens
LAFPLCSLY

SEQ ID NO: 1630 - protein, 9 aa, Homo Sapiens
AVLGNLTII

SEQ ID NO: 1631 - protein, 9 aa, Homo Sapiens
TIIYIVRTE

SEQ ID NO: 1632 - protein, 9 aa, Homo Sapiens
RTEHSLHEP

SEQ ID NO: 1633 - protein, 9 aa, Homo Sapiens
ISTSSMPKM

SEQ ID NO: 1634 - protein, 9 aa, Homo Sapiens
STTIQFDAC

SEQ ID NO: 1635 - protein, 9 aa, Homo Sapiens
ATVLTLPRV

SEQ ID NO: 1636 - protein, 9 aa, Homo Sapiens
GVAAVVRGA

SEQ ID NO: 1637 - protein, 9 aa, Homo Sapiens
GLIVIISAI

SEQ ID NO: 1638 - protein, 9 aa, Homo Sapiens
IGLSMVHRF

SEQ ID NO: 1639 - protein, 9 aa, Homo Sapiens
NIYLLVPPV

SEQ ID NO: 1640 - protein, 9 aa, Homo Sapiens
AFPLCSLYL

SEQ ID NO: 1641 - protein, 9 aa, Homo Sapiens
LQIFAIHSL

SEQ ID NO: 1642 - protein, 9 aa, Homo Sapiens
TVLLAMAFD

SEQ ID NO: 1643 - protein, 9 aa, Homo Sapiens
AICHPLRHA

SEQ ID NO: 1644 - protein, 9 aa, Homo Sapiens
RGAALMAPL

SEQ ID NO: 1645 - protein, 9 aa, Homo Sapiens
VFIKQLPFC

SEQ ID NO: 1646 - protein, 9 aa, Homo Sapiens
LISFSYLLI

SEQ ID NO: 1647 - protein, 9 aa, Homo Sapiens
ISFSYLLIL

SEQ ID NO: 1648 - protein, 9 aa, Homo Sapiens
KTVLGLTRE

SEQ ID NO: 1649 - protein, 9 aa, Homo Sapiens
PLPVILANI

SEQ ID NO: 1650 - protein, 9 aa, Homo Sapiens
LLVPPVLNP

SEQ ID NO: 1651 - protein, 9 aa, Homo Sapiens
PVLNPIVYG

SEQ ID NO: 1652 - protein, 9 aa, Homo Sapiens
VLNPIVYGV

SEQ ID NO: 1653 - protein, 9 aa, Homo Sapiens
KTKEIRQRI

SEQ ID NO: 1654 - protein, 9 aa, Homo Sapiens
RILRLFHVA

SEQ ID NO: 1655 - protein, 9 aa, Homo Sapiens
VLTLPRVTK

SEQ ID NO: 1656 - protein, 9 aa, Homo Sapiens
GLTREAQAK

SEQ ID NO: 1657 - protein, 9 aa, Homo Sapiens
KIGVAAVVR

SEQ ID NO: 1658 - protein, 9 aa, Homo Sapiens
AVVRGAALM

SEQ ID NO: 1659 - protein, 9 aa, Homo Sapiens
PIVYGVKTK

SEQ ID NO: 1660 - protein, 9 aa, Homo Sapiens
SLYLIAVLG

SEQ ID NO: 1661 - protein, 9 aa, Homo Sapiens
ALMAPLPVF

SEQ ID NO: 1662 - protein, 9 aa, Homo Sapiens
IIYIVRTEH

SEQ ID NO: 1663 - protein, 9 aa, Homo Sapiens
IVRTEHSLH

SEQ ID NO: 1664 - protein, 9 aa, Homo Sapiens
RVTKIGVAA

SEQ ID NO: 1665 - protein, 9 aa, Homo Sapiens
VVRGAALMA

SEQ ID NO: 1666 - protein, 9 aa, Homo Sapiens
CVSHVCAVF

SEQ ID NO: 1667 - protein, 9 aa, Homo Sapiens
AVFIFYVPF

SEQ ID NO: 1668 - protein, 9 aa, Homo Sapiens
VLLAMAFDR

SEQ ID NO: 1669 - protein, 9 aa, Homo Sapiens
DDIRVNVVY

SEQ ID NO: 1670 - protein, 9 aa, Homo Sapiens
RILRLFHVA

SEQ ID NO: 1671 - protein, 9 aa, Homo Sapiens
ILRLFHVAT

SEQ ID NO: 1672 - protein, 9 aa, Homo Sapiens
SLSGMESTV

SEQ ID NO: 1673 - protein, 9 aa, Homo Sapiens
VVYGLIVII

SEQ ID NO: 1674 - protein, 9 aa, Homo Sapiens
IVYGVKTKE

SEQ ID NO: 1675 - protein, 9 aa, Homo Sapiens
ILIGLPGLE

SEQ ID NO: 1676 - protein, 9 aa, Homo Sapiens
NLTIIYIVR

SEQ ID NO: 1677 - protein, 9 aa, Homo Sapiens
ILISTSSMP

SEQ ID NO: 1678 - protein, 9 aa, Homo Sapiens
LISTSSMPK

SEQ ID NO: 1679 - protein, 9 aa, Homo Sapiens
CLLQIFAIH

SEQ ID NO: 1680 - protein, 9 aa, Homo Sapiens
PVFIKQLPF

SEQ ID NO: 1681 - protein, 9 aa, Homo Sapiens
IVIISAIGL

SEQ ID NO: 1682 - protein, 9 aa, Homo Sapiens
LLILKTVLG

SEQ ID NO: 1683 - protein, 9 aa, Homo Sapiens
HVCAVFIFY

SEQ ID NO: 1684 - protein, 9 aa, Homo Sapiens
RLFHVATHA

SEQ ID NO: 1685 - protein, 9 aa, Homo Sapiens
AVLGNLTII

SEQ ID NO: 1686 - protein, 9 aa, Homo Sapiens
AIFWFNSTT

SEQ ID NO: 1687 - protein, 9 aa, Homo Sapiens
IISAIGLDS

SEQ ID NO: 1688 - protein, 9 aa, Homo Sapiens
YLLILKTVL

SEQ ID NO: 1689 - protein, 9 aa, Homo Sapiens
YVPFIGLSM

SEQ ID NO: 1690 - protein, 9 aa, Homo Sapiens
YLIAVLGNL

SEQ ID NO: 1691 - protein, 9 aa, Homo Sapiens
VLGNLTIIY

SEQ ID NO: 1692 - protein, 9 aa, Homo Sapiens
LLAMAFDRY

SEQ ID NO: 1693 - protein, 9 aa, Homo Sapiens
PLRHATVLT

SEQ ID NO: 1694 - protein, 9 aa, Homo Sapiens
TVLTLPRVT

SEQ ID NO: 1695 - protein, 9 aa, Homo Sapiens
YCLHQDVMK

SEQ ID NO: 1696 - protein, 9 aa, Homo Sapiens
GLIVIISAI

SEQ ID NO: 1697 - protein, 9 aa, Homo Sapiens
SLLISFSYL

SEQ ID NO: 1698 - protein, 9 aa, Homo Sapiens
FIGLSMVHR

SEQ ID NO: 1699 - protein, 9 aa, Homo Sapiens
MVHRFSKRR

SEQ ID NO: 1700 - protein, 9 aa, Homo Sapiens
ILANIYLLV

SEQ ID NO: 1701 - protein, 9 aa, Homo Sapiens
YLLVPPVLN

SEQ ID NO: 1702 - protein, 9 aa, Homo Sapiens
PVLNPIVYG

SEQ ID NO: 1703 - protein, 9 aa, Homo Sapiens
LNPIVYGVK

SEQ ID NO: 1704 - protein, 9 aa, Homo Sapiens
HVATHASEP

SEQ ID NO: 1705 - protein, 9 aa, Homo Sapiens
MVDPNGNES

SEQ ID NO: 1706 - protein, 9 aa, Homo Sapiens
SLHEPMYIF

SEQ ID NO: 1707 - protein, 9 aa, Homo Sapiens
GIDILISTS

SEQ ID NO: 1708 - protein, 9 aa, Homo Sapiens
DILISTSSM

SEQ ID NO: 1709 - protein, 9 aa, Homo Sapiens
TVLLAMAFD

SEQ ID NO: 1710 - protein, 9 aa, Homo Sapiens
YVAICHPLR

SEQ ID NO: 1711 - protein, 9 aa, Homo Sapiens
TKIGVAAVV

SEQ ID NO: 1712 - protein, 9 aa, Homo Sapiens
QLPFCRSNI

SEQ ID NO: 1713 - protein, 9 aa, Homo Sapiens
ILSHSYCLH

SEQ ID NO: 1714 - protein, 9 aa, Homo Sapiens
RVNVVYGLI

SEQ ID NO: 1715 - protein, 9 aa, Homo Sapiens
NVVYGLIVI

SEQ ID NO: 1716 - protein, 9 aa, Homo Sapiens
GLDSLLISF

SEQ ID NO: 1717 - protein, 9 aa, Homo Sapiens
LLVPPVLNP

SEQ ID NO: 1718 - protein, 9 aa, Homo Sapiens
EIRQRILRL

SEQ ID NO: 1719 - protein, 9 aa, Homo Sapiens
RQRILRLFH

SEQ ID NO: 1720 - protein, 9 aa, Homo Sapiens
LIGLPGLEE

SEQ ID NO: 1721 - protein, 9 aa, Homo Sapiens
TIIYIVRTE

SEQ ID NO: 1722 - protein, 9 aa, Homo Sapiens
QIFAIHSLS

SEQ ID NO: 1723 - protein, 9 aa, Homo Sapiens
DIRVNVVYG

SEQ ID NO: 1724 - protein, 9 aa, Homo Sapiens
AIGLDSLLI

SEQ ID NO: 1725 - protein, 9 aa, Homo Sapiens
ILKTVLGLT

SEQ ID NO: 1726 - protein, 9 aa, Homo Sapiens
KAFGTCVSH

SEQ ID NO: 1727 - protein, 9 aa, Homo Sapiens
HPLRHATVL

SEQ ID NO: 1728 - protein, 9 aa, Homo Sapiens
EPMYIFLCM

SEQ ID NO: 1729 - protein, 9 aa, Homo Sapiens
LPFCRSNIL

SEQ ID NO: 1730 - protein, 9 aa, Homo Sapiens
NPIVYGVKT

SEQ ID NO: 1731 - protein, 9 aa, Homo Sapiens
DPNGNESSA

SEQ ID NO: 1732 - protein, 9 aa, Homo Sapiens
LPGLEEAQF

SEQ ID NO: 1733 - protein, 9 aa, Homo Sapiens
LPRVTKIGV

SEQ ID NO: 1734 - protein, 9 aa, Homo Sapiens
VPPVLNPIV

SEQ ID NO: 1735 - protein, 9 aa, Homo Sapiens
FPLCSLYLI

SEQ ID NO: 1736 - protein, 9 aa, Homo Sapiens
VPFIGLSMV

SEQ ID NO: 1737 - protein, 9 aa, Homo Sapiens
RDSPLPVIL

SEQ ID NO: 1738 - protein, 9 aa, Homo Sapiens
AAVVRGAAL

SEQ ID NO: 1739 - protein, 9 aa, Homo Sapiens
RGAALMAPL

SEQ ID NO: 1740 - protein, 9 aa, Homo Sapiens
ALMAPLPVF

SEQ ID NO: 1741 - protein, 9 aa, Homo Sapiens
IFYVPFIGL

SEQ ID NO: 1742 - protein, 9 aa, Homo Sapiens
EIRQRILRL

SEQ ID NO: 1743 - protein, 9 aa, Homo Sapiens
ESSATYFIL

SEQ ID NO: 1744 - protein, 9 aa, Homo Sapiens
WLAFPLCSL

SEQ ID NO: 1745 - protein, 9 aa, Homo Sapiens
AFPLCSLYL

SEQ ID NO: 1746 - protein, 9 aa, Homo Sapiens
SGMESTVLL

SEQ ID NO: 1747 - protein, 9 aa, Homo Sapiens
LRHATVLTL

SEQ ID NO: 1748 - protein, 9 aa, Homo Sapiens
APLPVFIKQ

SEQ ID NO: 1749 - protein, 9 aa, Homo Sapiens
LILKTVLGL

SEQ ID NO: 1750 - protein, 9 aa, Homo Sapiens
SPLPVILAN

SEQ ID NO: 1751 - protein, 9 aa, Homo Sapiens
AQFWLAFPL

SEQ ID NO: 1752 - protein, 9 aa, Homo Sapiens
LSGMESTVL

SEQ ID NO: 1753 - protein, 9 aa, Homo Sapiens
RYVAICHPL

SEQ ID NO: 1754 - protein, 9 aa, Homo Sapiens
ISFSYLLIL

SEQ ID NO: 1755 - protein, 9 aa, Homo Sapiens
RRDSPLPVI

SEQ ID NO: 1756 - protein, 9 aa, Homo Sapiens
IYLLVPPVL

SEQ ID NO: 1757 - protein, 9 aa, Homo Sapiens
ATYFILIGL

SEQ ID NO: 1758 - protein, 9 aa, Homo Sapiens
CSLYLIAVL

SEQ ID NO: 1759 - protein, 9 aa, Homo Sapiens
LHEPMYIFL

SEQ ID NO: 1760 - protein, 9 aa, Homo Sapiens
STSSMPKML

SEQ ID NO: 1761 - protein, 9 aa, Homo Sapiens
RVTKIGVAA

SEQ ID NO: 1762 - protein, 9 aa, Homo Sapiens
VVRGAALMA

SEQ ID NO: 1763 - protein, 9 aa, Homo Sapiens
ACDDIRVNV

SEQ ID NO: 1764 - protein, 9 aa, Homo Sapiens
IRVNVVYGL

SEQ ID NO: 1765 - protein, 9 aa, Homo Sapiens
ISAIGLDSL

SEQ ID NO: 1766 - protein, 9 aa, Homo Sapiens
SAIGLDSLL

SEQ ID NO: 1767 - protein, 9 aa, Homo Sapiens
YLLILKTVL

SEQ ID NO: 1768 - protein, 9 aa, Homo Sapiens
KRRDSPLPV

SEQ ID NO: 1769 - protein, 9 aa, Homo Sapiens
ILRLFHVAT

SEQ ID NO: 1770 - protein, 9 aa, Homo Sapiens
FILIGLPGL

SEQ ID NO: 1771 - protein, 9 aa, Homo Sapiens
EEAQFWLAF

SEQ ID NO: 1772 - protein, 9 aa, Homo Sapiens
YLIAVLGNL

SEQ ID NO: 1773 - protein, 9 aa, Homo Sapiens
AVLGNLTII

SEQ ID NO: 1774 - protein, 9 aa, Homo Sapiens
TSSMPKMLA

SEQ ID NO: 1775 - protein, 9 aa, Homo Sapiens
SSMPKMLAI

SEQ ID NO: 1776 - protein, 9 aa, Homo Sapiens
MPKMLAIFW

SEQ ID NO: 1777 - protein, 9 aa, Homo Sapiens
TTIQFDACL

SEQ ID NO: 1778 - protein, 9 aa, Homo Sapiens
MESTVLLAM

SEQ ID NO: 1779 - protein, 9 aa, Homo Sapiens
AMAFDRYVA

SEQ ID NO: 1780 - protein, 9 aa, Homo Sapiens
AICHPLRHA

SEQ ID NO: 1781 - protein, 9 aa, Homo Sapiens
PLRHATVLT

SEQ ID NO: 1782 - protein, 9 aa, Homo Sapiens
AALMAPLPV

SEQ ID NO: 1783 - protein, 9 aa, Homo Sapiens
LMAPLPVFI

SEQ ID NO: 1784 - protein, 9 aa, Homo Sapiens
CLHQDVMKL

SEQ ID NO: 1785 - protein, 9 aa, Homo Sapiens
IVIISAIGL

SEQ ID NO: 1786 - protein, 9 aa, Homo Sapiens
AIGLDSLLI

SEQ ID NO: 1787 - protein, 9 aa, Homo Sapiens
SLLISFSYL

SEQ ID NO: 1788 - protein, 9 aa, Homo Sapiens
AVFIFYVPF

SEQ ID NO: 1789 - protein, 9 aa, Homo Sapiens
FSKRRDSPL

SEQ ID NO: 1790 - protein, 9 aa, Homo Sapiens
VILANIYLL

SEQ ID NO: 1791 - protein, 9 aa, Homo Sapiens
PPVLNPIVY

SEQ ID NO: 1792 - protein, 9 aa, Homo Sapiens
EIRQRILRL

SEQ ID NO: 1793 - protein, 9 aa, Homo Sapiens
FSKRRDSPL

SEQ ID NO: 1794 - protein, 9 aa, Homo Sapiens
AAVVRGAAL

SEQ ID NO: 1795 - protein, 9 aa, Homo Sapiens
LPFCRSNIL

SEQ ID NO: 1796 - protein, 9 aa, Homo Sapiens
GVKTKEIRQ

SEQ ID NO: 1797 - protein, 9 aa, Homo Sapiens
MAFDRYVAI

SEQ ID NO: 1798 - protein, 9 aa, Homo Sapiens
VYGVKTKEI

SEQ ID NO: 1799 - protein, 9 aa, Homo Sapiens
GLEEAQFWL

SEQ ID NO: 1800 - protein, 9 aa, Homo Sapiens
SSMPKMLAI

SEQ ID NO: 1801 - protein, 9 aa, Homo Sapiens
PLPVFIKQL

SEQ ID NO: 1802 - protein, 9 aa, Homo Sapiens
VMKLACDDI

SEQ ID NO: 1803 - protein, 9 aa, Homo Sapiens
SLLISFSYL

SEQ ID NO: 1804 - protein, 9 aa, Homo Sapiens
LLILKTVLG

SEQ ID NO: 1805 - protein, 9 aa, Homo Sapiens
KTKEIRQRI

SEQ ID NO: 1806 - protein, 9 aa, Homo Sapiens
TKEIRQRIL

SEQ ID NO: 1807 - protein, 9 aa, Homo Sapiens
HPLRHATVL

SEQ ID NO: 1808 - protein, 9 aa, Homo Sapiens
CLHQDVMKL

SEQ ID NO: 1809 - protein, 9 aa, Homo Sapiens
ILKTVLGLT

SEQ ID NO: 1810 - protein, 9 aa, Homo Sapiens
WLAFPLCSL

SEQ ID NO: 1811 - protein, 9 aa, Homo Sapiens
YLIAVLGNL

SEQ ID NO: 1812 - protein, 9 aa, Homo Sapiens
SLHEPMYIF

SEQ ID NO: 1813 - protein, 9 aa, Homo Sapiens
MPKMLAIFW

SEQ ID NO: 1814 - protein, 9 aa, Homo Sapiens
PVFIKQLPF

SEQ ID NO: 1815 - protein, 9 aa, Homo Sapiens
GLIVIISAI

SEQ ID NO: 1816 - protein, 9 aa, Homo Sapiens
SAIGLDSLL

SEQ ID NO: 1817 - protein, 9 aa, Homo Sapiens
LLISFSYLL

SEQ ID NO: 1818 - protein, 9 aa, Homo Sapiens
YLLILKTVL

SEQ ID NO: 1819 - protein, 9 aa, Homo Sapiens
EAQAKAFGT

SEQ ID NO: 1820 - protein, 9 aa, Homo Sapiens
VILANIYLL

SEQ ID NO: 1821 - protein, 9 aa, Homo Sapiens
ILRLFHVAT

SEQ ID NO: 1822 - protein, 9 aa, Homo Sapiens
FILIGLPGL

SEQ ID NO: 1823 - protein, 9 aa, Homo Sapiens
SGMESTVLL

SEQ ID NO: 1824 - protein, 9 aa, Homo Sapiens
LTLPRVTKI

SEQ ID NO: 1825 - protein, 9 aa, Homo Sapiens
FIKQLPFCR

SEQ ID NO: 1826 - protein, 9 aa, Homo Sapiens
LILKTVLGL

SEQ ID NO: 1827 - protein, 9 aa, Homo Sapiens
LHEPMYIFL

SEQ ID NO: 1828 - protein, 9 aa, Homo Sapiens
SHVCAVFIF

SEQ ID NO: 1829 - protein, 9 aa, Homo Sapiens
RDSPLPVIL

SEQ ID NO: 1830 - protein, 9 aa, Homo Sapiens
IYLLVPPVL

SEQ ID NO: 1831 - protein, 9 aa, Homo Sapiens
VHRFSKRRD

SEQ ID NO: 1832 - protein, 9 aa, Homo Sapiens
EIRQRILRL

SEQ ID NO: 1833 - protein, 9 aa, Homo Sapiens
IHSLSGMES

SEQ ID NO: 1834 - protein, 9 aa, Homo Sapiens
ISAIGLDSL

SEQ ID NO: 1835 - protein, 9 aa, Homo Sapiens
YLLILKTVL

SEQ ID NO: 1836 - protein, 9 aa, Homo Sapiens
IFYVPFIGL

SEQ ID NO: 1837 - protein, 9 aa, Homo Sapiens
TKEIRQRIL

SEQ ID NO: 1838 - protein, 9 aa, Homo Sapiens
GLEEAQFWL

SEQ ID NO: 1839 - protein, 9 aa, Homo Sapiens
CSLYLIAVL

SEQ ID NO: 1840 - protein, 9 aa, Homo Sapiens
EHSLHEPMY

SEQ ID NO: 1841 - protein, 9 aa, Homo Sapiens
SGMESTVLL

SEQ ID NO: 1842 - protein, 9 aa, Homo Sapiens
IRVNVVYGL

SEQ ID NO: 1843 - protein, 9 aa, Homo Sapiens
ESSATYFIL

SEQ ID NO: 1844 - protein, 9 aa, Homo Sapiens
FILIGLPGL

SEQ ID NO: 1845 - protein, 9 aa, Homo Sapiens
WLAFPLCSL

SEQ ID NO: 1846 - protein, 9 aa, Homo Sapiens
CMLSGIDIL

SEQ ID NO: 1847 - protein, 9 aa, Homo Sapiens
STSSMPKML

SEQ ID NO: 1848 - protein, 9 aa, Homo Sapiens
TTIQFDACL

SEQ ID NO: 1849 - protein, 9 aa, Homo Sapiens
LSGMESTVL

SEQ ID NO: 1850 - protein, 9 aa, Homo Sapiens
HPLRHATVL

SEQ ID NO: 1851 - protein, 9 aa, Homo Sapiens
LRHATVLTL

SEQ ID NO: 1852 - protein, 9 aa, Homo Sapiens
AAVVRGAAL

SEQ ID NO: 1853 - protein, 9 aa, Homo Sapiens
RGAALMAPL

SEQ ID NO: 1854 - protein, 9 aa, Homo Sapiens
PLPVFIKQL

SEQ ID NO: 1855 - protein, 9 aa, Homo Sapiens
CLHQDVMKL

SEQ ID NO: 1856 - protein, 9 aa, Homo Sapiens
LHQDVMKLA

SEQ ID NO: 1857 - protein, 9 aa, Homo Sapiens
IVIISAIGL

SEQ ID NO: 1858 - protein, 9 aa, Homo Sapiens
ISFSYLLIL

SEQ ID NO: 1859 - protein, 9 aa, Homo Sapiens
LILKTVLGL

SEQ ID NO: 1860 - protein, 9 aa, Homo Sapiens
VILANIYLL

SEQ ID NO: 1861 - protein, 9 aa, Homo Sapiens
YLIAVLGNL

SEQ ID NO: 1862 - protein, 9 aa, Homo Sapiens
YIVRTEHSL

SEQ ID NO: 1863 - protein, 9 aa, Homo Sapiens
TIQFDACLL

SEQ ID NO: 1864 - protein, 9 aa, Homo Sapiens
LQIFAIHSL

SEQ ID NO: 1865 - protein, 9 aa, Homo Sapiens
CHPLRHATV

SEQ ID NO: 1866 - protein, 9 aa, Homo Sapiens
RHATVLTLP

SEQ ID NO: 1867 - protein, 9 aa, Homo Sapiens
SHSYCLHQD

SEQ ID NO: 1868 - protein, 9 aa, Homo Sapiens
SAIGLDSLL

SEQ ID NO: 1869 - protein, 9 aa, Homo Sapiens
IGLSMVHRF

SEQ ID NO: 1870 - protein, 9 aa, Homo Sapiens
IRVNVVYGL

SEQ ID NO: 1871 - protein, 9 aa, Homo Sapiens
RRDSPLPVI

SEQ ID NO: 1872 - protein, 9 aa, Homo Sapiens
LRHATVLTL

SEQ ID NO: 1873 - protein, 9 aa, Homo Sapiens
IRQRILRLF

SEQ ID NO: 1874 - protein, 9 aa, Homo Sapiens
LRLFHVATH

SEQ ID NO: 1875 - protein, 9 aa, Homo Sapiens
TREAQAKAF

SEQ ID NO: 1876 - protein, 9 aa, Homo Sapiens
CSLYLIAVL

SEQ ID NO: 1877 - protein, 9 aa, Homo Sapiens
EIRQRILRL

SEQ ID NO: 1878 - protein, 9 aa, Homo Sapiens
GNESSATYF

SEQ ID NO: 1879 - protein, 9 aa, Homo Sapiens
CMLSGIDIL

SEQ ID NO: 1880 - protein, 9 aa, Homo Sapiens
PVFIKQLPF

SEQ ID NO: 1881 - protein, 9 aa, Homo Sapiens
SAIGLDSLL

SEQ ID NO: 1882 - protein, 9 aa, Homo Sapiens
GLDSLLISF

SEQ ID NO: 1883 - protein, 9 aa, Homo Sapiens
YLLILKTVL

SEQ ID NO: 1884 - protein, 9 aa, Homo Sapiens
KAFGTCVSH

SEQ ID NO: 1885 - protein, 9 aa, Homo Sapiens
RDSPLPVIL

SEQ ID NO: 1886 - protein, 9 aa, Homo Sapiens
IYLLVPPVL

SEQ ID NO: 1887 - protein, 9 aa, Homo Sapiens
VKTKEIRQR

SEQ ID NO: 1888 - protein, 9 aa, Homo Sapiens
ATYFILIGL

SEQ ID NO: 1889 - protein, 9 aa, Homo Sapiens
FILIGLPGL

SEQ ID NO: 1890 - protein, 9 aa, Homo Sapiens
GLEEAQFWL

SEQ ID NO: 1891 - protein, 9 aa, Homo Sapiens
AQFWLAFPL

SEQ ID NO: 1892 - protein, 9 aa, Homo Sapiens
YLIAVLGNL

SEQ ID NO: 1893 - protein, 9 aa, Homo Sapiens
TTIQFDACL

SEQ ID NO: 1894 - protein, 9 aa, Homo Sapiens
LQIFAIHSL

SEQ ID NO: 1895 - protein, 9 aa, Homo Sapiens
RYVAICHPL

SEQ ID NO: 1896 - protein, 9 aa, Homo Sapiens
HPLRHATVL

SEQ ID NO: 1897 - protein, 9 aa, Homo Sapiens
PRVTKIGVA

SEQ ID NO: 1898 - protein, 9 aa, Homo Sapiens
RGAALMAPL

SEQ ID NO: 1899 - protein, 9 aa, Homo Sapiens
CLHQDVMKL

SEQ ID NO: 1900 - protein, 9 aa, Homo Sapiens
GLIVIISAI

SEQ ID NO: 1901 - protein, 9 aa, Homo Sapiens
IVIISAIGL

SEQ ID NO: 1902 - protein, 9 aa, Homo Sapiens
ISFSYLLIL

SEQ ID NO: 1903 - protein, 9 aa, Homo Sapiens
LILKTVLGL

SEQ ID NO: 1904 - protein, 9 aa, Homo Sapiens
PFIGLSMVH

SEQ ID NO: 1905 - protein, 9 aa, Homo Sapiens
IGLSMVHRF

SEQ ID NO: 1906 - protein, 9 aa, Homo Sapiens
VILANIYLL

SEQ ID NO: 1907 - protein, 9 aa, Homo Sapiens
IIYIVRTEH

SEQ ID NO: 1908 - protein, 9 aa, Homo Sapiens
LSGMESTVL

SEQ ID NO: 1909 - protein, 9 aa, Homo Sapiens
STVLLAMAF

SEQ ID NO: 1910 - protein, 9 aa, Homo Sapiens
DRYVAICHP

SEQ ID NO: 1911 - protein, 9 aa, Homo Sapiens
KIGVAAVVR

SEQ ID NO: 1912 - protein, 9 aa, Homo Sapiens
ALMAPLPVF

SEQ ID NO: 1913 - protein, 9 aa, Homo Sapiens
LPFCRSNIL

SEQ ID NO: 1914 - protein, 9 aa, Homo Sapiens
RSNILSHSY

SEQ ID NO: 1915 - protein, 9 aa, Homo Sapiens
VVYGLIVII

SEQ ID NO: 1916 - protein, 9 aa, Homo Sapiens
ISAIGLDSL

SEQ ID NO: 1917 - protein, 9 aa, Homo Sapiens
GLTREAQAK

SEQ ID NO: 1918 - protein, 9 aa, Homo Sapiens
AVFIFYVPF

SEQ ID NO: 1919 - protein, 9 aa, Homo Sapiens
IFYVPFIGL

SEQ ID NO: 1920 - protein, 9 aa, Homo Sapiens
PVILANIYL

SEQ ID NO: 1921 - protein, 9 aa, Homo Sapiens
PIVYGVKTK

SEQ ID NO: 1922 - protein, 9 aa, Homo Sapiens
KEIRQRILR

SEQ ID NO: 1923 - protein, 9 aa, Homo Sapiens
LPGLEEAQF

SEQ ID NO: 1924 - protein, 9 aa, Homo Sapiens
LAFPLCSLY

SEQ ID NO: 1925 - protein, 9 aa, Homo Sapiens
AFPLCSLYL

SEQ ID NO: 1926 - protein, 9 aa, Homo Sapiens
IAVLGNLTI

SEQ ID NO: 1927 - protein, 9 aa, Homo Sapiens
AVLGNLTII

SEQ ID NO: 1928 - protein, 9 aa, Homo Sapiens
SMPKMLAIF

SEQ ID NO: 1929 - protein, 9 aa, Homo Sapiens
PKMLAIFWF

SEQ ID NO: 1930 - protein, 9 aa, Homo Sapiens
CLLQIFAIH

SEQ ID NO: 1931 - protein, 9 aa, Homo Sapiens
VLTLPRVTK

SEQ ID NO: 1932 - protein, 9 aa, Homo Sapiens
LTLPRVTKI

SEQ ID NO: 1933 - protein, 9 aa, Homo Sapiens
AVVRGAALM

SEQ ID NO: 1934 - protein, 9 aa, Homo Sapiens
PLPVFIKQL

SEQ ID NO: 1935 - protein, 9 aa, Homo Sapiens
NILSHSYCL

SEQ ID NO: 1936 - protein, 9 aa, Homo Sapiens
YCLHQDVMK

SEQ ID NO: 1937 - protein, 9 aa, Homo Sapiens
DDIRVNVVY

SEQ ID NO: 1938 - protein, 9 aa, Homo Sapiens
DSLLISFSY

SEQ ID NO: 1939 - protein, 9 aa, Homo Sapiens
SLLISFSYL

SEQ ID NO: 1940 - protein, 9 aa, Homo Sapiens
LLISFSYLL

SEQ ID NO: 1941 - protein, 9 aa, Homo Sapiens
SMVHRFSKR

SEQ ID NO: 1942 - protein, 9 aa, Homo Sapiens
HRFSKRRDS

SEQ ID NO: 1943 - protein, 9 aa, Homo Sapiens
KRRDSPLPV

SEQ ID NO: 1944 - protein, 9 aa, Homo Sapiens
YGVKTKEIR

SEQ ID NO: 1945 - protein, 9 aa, Homo Sapiens
RQRILRLFH

SEQ ID NO: 1946 - protein, 9 aa, Homo Sapiens
QRILRLFHV

SEQ ID NO: 1947 - protein, 9 aa, Homo Sapiens
NGNESSATY

SEQ ID NO: 1948 - protein, 9 aa, Homo Sapiens
EEAQFWLAF

SEQ ID NO: 1949 - protein, 9 aa, Homo Sapiens
WLAFPLCSL

SEQ ID NO: 1950 - protein, 9 aa, Homo Sapiens
NLTIIYIVR

SEQ ID NO: 1951 - protein, 9 aa, Homo Sapiens
VRTEHSLHE

SEQ ID NO: 1952 - protein, 9 aa, Homo Sapiens
SLHEPMYIF

SEQ ID NO: 1953 - protein, 9 aa, Homo Sapiens
PMYIFLCML

SEQ ID NO: 1954 - protein, 9 aa, Homo Sapiens
DILISTSSM

SEQ ID NO: 1955 - protein, 9 aa, Homo Sapiens
LISTSSMPK

SEQ ID NO: 1956 - protein, 9 aa, Homo Sapiens
ISTSSMPKM

SEQ ID NO: 1957 - protein, 9 aa, Homo Sapiens
ACLLQIFAI

SEQ ID NO: 1958 - protein, 9 aa, Homo Sapiens
FAIHSLSGM

SEQ ID NO: 1959 - protein, 9 aa, Homo Sapiens
SGMESTVLL

SEQ ID NO: 1960 - protein, 9 aa, Homo Sapiens
VLLAMAFDR

SEQ ID NO: 1961 - protein, 9 aa, Homo Sapiens
VAICHPLRH

SEQ ID NO: 1962 - protein, 9 aa, Homo Sapiens
AAVVRGAAL

SEQ ID NO: 1963 - protein, 9 aa, Homo Sapiens
MAPLPVFIK

SEQ ID NO: 1964 - protein, 9 aa, Homo Sapiens
FIKQLPFCR

SEQ ID NO: 1965 - protein, 9 aa, Homo Sapiens
FCRSNILSH

SEQ ID NO: 1966 - protein, 9 aa, Homo Sapiens
CRSNILSHS

SEQ ID NO: 1967 - protein, 9 aa, Homo Sapiens
MKLACDDIR

SEQ ID NO: 1968 - protein, 9 aa, Homo Sapiens
SFSYLLILK

SEQ ID NO: 1969 - protein, 9 aa, Homo Sapiens
LKTVLGLTR

SEQ ID NO: 1970 - protein, 9 aa, Homo Sapiens
CVSHVCAVF

SEQ ID NO: 1971 - protein, 9 aa, Homo Sapiens
FIGLSMVHR

SEQ ID NO: 1972 - protein, 9 aa, Homo Sapiens
MVHRFSKRR

SEQ ID NO: 1973 - protein, 9 aa, Homo Sapiens
YIVRTEHSL

SEQ ID NO: 1974 - protein, 9 aa, Homo Sapiens
LHEPMYIFL

SEQ ID NO: 1975 - protein, 9 aa, Homo Sapiens
WFNSTTIQF

SEQ ID NO: 1976 - protein, 9 aa, Homo Sapiens
FDACLLQIF

SEQ ID NO: 1977 - protein, 9 aa, Homo Sapiens
HATVLTLPR

SEQ ID NO: 1978 - protein, 9 aa, Homo Sapiens
VRGAALMAP

SEQ ID NO: 1979 - protein, 9 aa, Homo Sapiens
SYCLHQDVM

SEQ ID NO: 1980 - protein, 9 aa, Homo Sapiens
NVVYGLIVI

SEQ ID NO: 1981 - protein, 9 aa, Homo Sapiens
SHVCAVFIF

SEQ ID NO: 1982 - protein, 9 aa, Homo Sapiens
FSKRRDSPL

SEQ ID NO: 1983 - protein, 9 aa, Homo Sapiens
LPVILANIY

SEQ ID NO: 1984 - protein, 9 aa, Homo Sapiens
PPVLNPIVY

SEQ ID NO: 1985 - protein, 9 aa, Homo Sapiens
LNPIVYGVK

SEQ ID NO: 1986 - protein, 9 aa, Homo Sapiens
KTKEIRQRI

SEQ ID NO: 1987 - protein, 9 aa, Homo Sapiens
TKEIRQRIL

SEQ ID NO: 1988 - protein, 9 aa, Homo Sapiens
IRVNVVYGL

SEQ ID NO: 1989 - protein, 9 aa, Homo Sapiens
RRDSPLPVI

SEQ ID NO: 1990 - protein, 9 aa, Homo Sapiens
LRHATVLTL

SEQ ID NO: 1991 - protein, 9 aa, Homo Sapiens
KRRDSPLPV

SEQ ID NO: 1992 - protein, 9 aa, Homo Sapiens
IRQRILRLF

SEQ ID NO: 1993 - protein, 9 aa, Homo Sapiens
TREAQAKAF

SEQ ID NO: 1994 - protein, 9 aa, Homo Sapiens
QRILRLFHV

SEQ ID NO: 1995 - protein, 9 aa, Homo Sapiens
RYVAICHPL

SEQ ID NO: 1996 - protein, 9 aa, Homo Sapiens
RDSPLPVIL

SEQ ID NO: 1997 - protein, 9 aa, Homo Sapiens
GNLTIIYIV

SEQ ID NO: 1998 - protein, 9 aa, Homo Sapiens
ISFSYLLIL

SEQ ID NO: 1999 - protein, 9 aa, Homo Sapiens
ATYFILIGL

SEQ ID NO: 2000 - protein, 9 aa, Homo Sapiens
AQFWLAFPL

SEQ ID NO: 2001 - protein, 9 aa, Homo Sapiens
RGAALMAPL

SEQ ID NO: 2002 - protein, 9 aa, Homo Sapiens
NILSHSYCL

SEQ ID NO: 2003 - protein, 9 aa, Homo Sapiens
LILKTVLGL

SEQ ID NO: 2004 - protein, 9 aa, Homo Sapiens
IGLSMVHRF

SEQ ID NO: 2005 - protein, 9 aa, Homo Sapiens
IYLLVPPVL

SEQ ID NO: 2006 - protein, 9 aa, Homo Sapiens
GNESSATYF

SEQ ID NO: 2007 - protein, 9 aa, Homo Sapiens
FILIGLPGL

SEQ ID NO: 2008 - protein, 9 aa, Homo Sapiens
GLEEAQFWL

SEQ ID NO: 2009 - protein, 9 aa, Homo Sapiens
CMLSGIDIL

SEQ ID NO: 2010 - protein, 9 aa, Homo Sapiens
HPLRHATVL

SEQ ID NO: 2011 - protein, 9 aa, Homo Sapiens
GLIVIISAI

SEQ ID NO: 2012 - protein, 9 aa, Homo Sapiens
IVIISAIGL

SEQ ID NO: 2013 - protein, 9 aa, Homo Sapiens
LLISFSYLL

SEQ ID NO: 2014 - protein, 9 aa, Homo Sapiens
IFYVPFIGL

SEQ ID NO: 2015 - protein, 9 aa, Homo Sapiens
HRFSKRRDS

SEQ ID NO: 2016 - protein, 9 aa, Homo Sapiens
VILANIYLL

SEQ ID NO: 2017 - protein, 9 aa, Homo Sapiens
LRLFHVATH

SEQ ID NO: 2018 - protein, 9 aa, Homo Sapiens
AFPLCSLYL

SEQ ID NO: 2019 - protein, 9 aa, Homo Sapiens
CSLYLIAVL

SEQ ID NO: 2020 - protein, 9 aa, Homo Sapiens
YLIAVLGNL

SEQ ID NO: 2021 - protein, 9 aa, Homo Sapiens
VRTEHSLHE

SEQ ID NO: 2022 - protein, 9 aa, Homo Sapiens
PMYIFLCML

SEQ ID NO: 2023 - protein, 9 aa, Homo Sapiens
ISTSSMPKM

SEQ ID NO: 2024 - protein, 9 aa, Homo Sapiens
TIQFDACLL

SEQ ID NO: 2025 - protein, 9 aa, Homo Sapiens
DRYVAICHP

SEQ ID NO: 2026 - protein, 9 aa, Homo Sapiens
ATVLTLPRV

SEQ ID NO: 2027 - protein, 9 aa, Homo Sapiens
LTLPRVTKI

SEQ ID NO: 2028 - protein, 9 aa, Homo Sapiens
AAVVRGAAL

SEQ ID NO: 2029 - protein, 9 aa, Homo Sapiens
AALMAPLPV

SEQ ID NO: 2030 - protein, 9 aa, Homo Sapiens
LPFCRSNIL

SEQ ID NO: 2031 - protein, 9 aa, Homo Sapiens
CLHQDVMKL

SEQ ID NO: 2032 - protein, 9 aa, Homo Sapiens
KLACDDIRV

SEQ ID NO: 2033 - protein, 9 aa, Homo Sapiens
ACDDIRVNV

SEQ ID NO: 2034 - protein, 9 aa, Homo Sapiens
RVNVVYGLI

SEQ ID NO: 2035 - protein, 9 aa, Homo Sapiens
GLDSLLISF

SEQ ID NO: 2036 - protein, 9 aa, Homo Sapiens
SLLISFSYL

SEQ ID NO: 2037 - protein, 9 aa, Homo Sapiens
YLLILKTVL

SEQ ID NO: 2038 - protein, 9 aa, Homo Sapiens
AVFIFYVPF

SEQ ID NO: 2039 - protein, 9 aa, Homo Sapiens
NIYLLVPPV

SEQ ID NO: 2040 - protein, 9 aa, Homo Sapiens
VLNPIVYGV

SEQ ID NO: 2041 - protein, 9 aa, Homo Sapiens
KTKEIRQRI

SEQ ID NO: 2042 - protein, 9 aa, Homo Sapiens
EIRQRILRL

SEQ ID NO: 2043 - protein, 9 aa, Homo Sapiens
IAVLGNLTI

SEQ ID NO: 2044 - protein, 9 aa, Homo Sapiens
FPLCSLYLI

SEQ ID NO: 2045 - protein, 9 aa, Homo Sapiens
MAFDRYVAI

SEQ ID NO: 2046 - protein, 9 aa, Homo Sapiens
HPLRHATVL

SEQ ID NO: 2047 - protein, 9 aa, Homo Sapiens
LAMAFDRYV

SEQ ID NO: 2048 - protein, 9 aa, Homo Sapiens
LPRVTKIGV

SEQ ID NO: 2049 - protein, 9 aa, Homo Sapiens
AALMAPLPV

SEQ ID NO: 2050 - protein, 9 aa, Homo Sapiens
LGNLTIIYI

SEQ ID NO: 2051 - protein, 9 aa, Homo Sapiens
VPFIGLSMV

SEQ ID NO: 2052 - protein, 9 aa, Homo Sapiens
VPPVLNPIV

SEQ ID NO: 2053 - protein, 9 aa, Homo Sapiens
LPFCRSNIL

SEQ ID NO: 2054 - protein, 9 aa, Homo Sapiens
QAKAFGTCV

SEQ ID NO: 2055 - protein, 9 aa, Homo Sapiens
LTLPRVTKI

SEQ ID NO: 2056 - protein, 9 aa, Homo Sapiens
APLPVFIKQ

SEQ ID NO: 2057 - protein, 9 aa, Homo Sapiens
LACDDIRVN

SEQ ID NO: 2058 - protein, 9 aa, Homo Sapiens
VVYGLIVII

SEQ ID NO: 2059 - protein, 9 aa, Homo Sapiens
LANIYLLVP

SEQ ID NO: 2060 - protein, 9 aa, Homo Sapiens
SAIGLDSLL

SEQ ID NO: 2061 - protein, 9 aa, Homo Sapiens
LVPPVLNPI

SEQ ID NO: 2062 - protein, 9 aa, Homo Sapiens
IFLCMLSGI

SEQ ID NO: 2063 - protein, 9 aa, Homo Sapiens
IFWFNSTTI

SEQ ID NO: 2064 - protein, 9 aa, Homo Sapiens
SGMESTVLL

SEQ ID NO: 2065 - protein, 9 aa, Homo Sapiens
TKIGVAAVV

SEQ ID NO: 2066 - protein, 9 aa, Homo Sapiens
AAVVRGAAL

SEQ ID NO: 2067 - protein, 9 aa, Homo Sapiens
NVVYGLIVI

SEQ ID NO: 2068 - protein, 9 aa, Homo Sapiens
SPLPVILAN

SEQ ID NO: 2069 - protein, 9 aa, Homo Sapiens
IYLLVPPVL

SEQ ID NO: 2070 - protein, 9 aa, Homo Sapiens
DPNGNESSA

SEQ ID NO: 2071 - protein, 9 aa, Homo Sapiens
AVLGNLTII

SEQ ID NO: 2072 - protein, 9 aa, Homo Sapiens
DACLLQIFA

SEQ ID NO: 2073 - protein, 9 aa, Homo Sapiens
LRHATVLTL

SEQ ID NO: 2074 - protein, 9 aa, Homo Sapiens
LILKTVLGL

SEQ ID NO: 2075 - protein, 9 aa, Homo Sapiens
NIYLLVPPV

SEQ ID NO: 2076 - protein, 9 aa, Homo Sapiens
PPVLNPIVY

SEQ ID NO: 2077 - protein, 9 aa, Homo Sapiens
NPIVYGVKT

SEQ ID NO: 2078 - protein, 9 aa, Homo Sapiens
SSATYFILI

SEQ ID NO: 2079 - protein, 9 aa, Homo Sapiens
LCMLSGIDI

SEQ ID NO: 2080 - protein, 9 aa, Homo Sapiens
LAIFWFNST

SEQ ID NO: 2081 - protein, 9 aa, Homo Sapiens
VAICHPLRH

SEQ ID NO: 2082 - protein, 9 aa, Homo Sapiens
LMAPLPVFI

SEQ ID NO: 2083 - protein, 9 aa, Homo Sapiens
MAPLPVFIK

SEQ ID NO: 2084 - protein, 9 aa, Homo Sapiens
CDDIRVNVV

SEQ ID NO: 2085 - protein, 9 aa, Homo Sapiens
YGLIVIISA

SEQ ID NO: 2086 - protein, 9 aa, Homo Sapiens
IGLDSLLIS

SEQ ID NO: 2087 - protein, 9 aa, Homo Sapiens
LISFSYLLI

SEQ ID NO: 2088 - protein, 9 aa, Homo Sapiens
SYLLILKTV

SEQ ID NO: 2089 - protein, 9 aa, Homo Sapiens
YLLILKTVL

SEQ ID NO: 2090 - protein, 9 aa, Homo Sapiens
KAFGTCVSH

SEQ ID NO: 2091 - protein, 9 aa, Homo Sapiens
CAVFIFYVP

SEQ ID NO: 2092 - protein, 9 aa, Homo Sapiens
VFIFYVPFI

SEQ ID NO: 2093 - protein, 9 aa, Homo Sapiens
IFYVPFIGL

SEQ ID NO: 2094 - protein, 9 aa, Homo Sapiens
IGLSMVHRF

SEQ ID NO: 2095 - protein, 9 aa, Homo Sapiens
RRDSPLPVI

SEQ ID NO: 2096 - protein, 9 aa, Homo Sapiens
LPVILANIY

SEQ ID NO: 2097 - protein, 9 aa, Homo Sapiens
LAFPLCSLY

SEQ ID NO: 2098 - protein, 9 aa, Homo Sapiens
LCSLYLIAV

SEQ ID NO: 2099 - protein, 9 aa, Homo Sapiens
HSLHEPMYI

SEQ ID NO: 2100 - protein, 9 aa, Homo Sapiens
MLSGIDILI

SEQ ID NO: 2101 - protein, 9 aa, Homo Sapiens
MPKMLAIFW

SEQ ID NO: 2102 - protein, 9 aa, Homo Sapiens
QFDACLLQI

SEQ ID NO: 2103 - protein, 9 aa, Homo Sapiens
ACLLQIFAI

SEQ ID NO: 2104 - protein, 9 aa, Homo Sapiens
FAIHSLSGM

SEQ ID NO: 2105 - protein, 9 aa, Homo Sapiens
IGVAAVVRG

SEQ ID NO: 2106 - protein, 9 aa, Homo Sapiens
VAAVVRGAA

SEQ ID NO: 2107 - protein, 9 aa, Homo Sapiens
RGAALMAPL

SEQ ID NO: 2108 - protein, 9 aa, Homo Sapiens
EAQAKAFGT

SEQ ID NO: 2109 - protein, 9 aa, Homo Sapiens
VSHVCAVFI

SEQ ID NO: 2110 - protein, 9 aa, Homo Sapiens
VYGVKTKEI

SEQ ID NO: 2111 - protein, 9 aa, Homo Sapiens
KTKEIRQRI

SEQ ID NO: 2112 - protein, 10 aa, Homo Sapiens
CDDIRVNVVY

SEQ ID NO: 2113 - protein, 10 aa, Homo Sapiens
SHVCAVFIFY

SEQ ID NO: 2114 - protein, 10 aa, Homo Sapiens
AVLGNLTIIY

SEQ ID NO: 2115 - protein, 10 aa, Homo Sapiens
VPPVLNPIVY

SEQ ID NO: 2116 - protein, 10 aa, Homo Sapiens
VLLAMAFDRY

SEQ ID NO: 2117 - protein, 10 aa, Homo Sapiens
WLAFPLCSLY

SEQ ID NO: 2118 - protein, 10 aa, Homo Sapiens
TKEIRQRILR

SEQ ID NO: 2119 - protein, 10 aa, Homo Sapiens
GLEEAQFWLA

SEQ ID NO: 2120 - protein, 10 aa, Homo Sapiens
LEEAQFWLAF

SEQ ID NO: 2121 - protein, 10 aa, Homo Sapiens
RTEHSLHEPM

SEQ ID NO: 2122 - protein, 10 aa, Homo Sapiens
TEHSLHEPMY

SEQ ID NO: 2123 - protein, 10 aa, Homo Sapiens
LHEPMYIFLC

SEQ ID NO: 2124 - protein, 10 aa, Homo Sapiens
GMESTVLLAM

SEQ ID NO: 2125 - protein, 10 aa, Homo Sapiens
PLPVILANIY

SEQ ID NO: 2126 - protein, 10 aa, Homo Sapiens
MVDPNGNESS

SEQ ID NO: 2127 - protein, 10 aa, Homo Sapiens
PNGNESSATY

SEQ ID NO: 2128 - protein, 10 aa, Homo Sapiens
AFDRYVAICH

SEQ ID NO: 2129 - protein, 10 aa, Homo Sapiens
CRSNILSHSY

SEQ ID NO: 2130 - protein, 10 aa, Homo Sapiens
LDSLLISFSY

SEQ ID NO: 2131 - protein, 10 aa, Homo Sapiens
ESSATYFILI

SEQ ID NO: 2132 - protein, 10 aa, Homo Sapiens
ACDDIRVNVV

SEQ ID NO: 2133 - protein, 10 aa, Homo Sapiens
LLILKTVLGL

SEQ ID NO: 2134 - protein, 10 aa, Homo Sapiens
LLQIFAIHSL

SEQ ID NO: 2135 - protein, 10 aa, Homo Sapiens
LLVPPVLNPI

SEQ ID NO: 2136 - protein, 10 aa, Homo Sapiens
IISAIGLDSL

SEQ ID NO: 2137 - protein, 10 aa, Homo Sapiens
SLLISFSYLL

SEQ ID NO: 2138 - protein, 10 aa, Homo Sapiens
SLHEPMYIFL

SEQ ID NO: 2139 - protein, 10 aa, Homo Sapiens
YIFLCMLSGI

SEQ ID NO: 2140 - protein, 10 aa, Homo Sapiens
SLSGMESTVL

SEQ ID NO: 2141 - protein, 10 aa, Homo Sapiens
LLAMAFDRYV

SEQ ID NO: 2142 - protein, 10 aa, Homo Sapiens
PLRHATVLTL

SEQ ID NO: 2143 - protein, 10 aa, Homo Sapiens
VLTLPRVTKI

SEQ ID NO: 2144 - protein, 10 aa, Homo Sapiens
LISFSYLLIL

SEQ ID NO: 2145 - protein, 10 aa, Homo Sapiens
LIAVLGNLTI

SEQ ID NO: 2146 - protein, 10 aa, Homo Sapiens
VLGNLTIIYI

SEQ ID NO: 2147 - protein, 10 aa, Homo Sapiens
ALMAPLPVFI

SEQ ID NO: 2148 - protein, 10 aa, Homo Sapiens
DIRVNVVYGL

SEQ ID NO: 2149 - protein, 10 aa, Homo Sapiens
LLISFSYLLI

SEQ ID NO: 2150 - protein, 10 aa, Homo Sapiens
PLCSLYLIAV

SEQ ID NO: 2151 - protein, 10 aa, Homo Sapiens
AMAFDRYVAI

SEQ ID NO: 2152 - protein, 10 aa, Homo Sapiens
KAFGTCVSHV

SEQ ID NO: 2153 - protein, 10 aa, Homo Sapiens
VILANIYLLV

SEQ ID NO: 2154 - protein, 10 aa, Homo Sapiens
AIFWFNSTTI

SEQ ID NO: 2155 - protein, 10 aa, Homo Sapiens
TLPRVTKIGV

SEQ ID NO: 2156 - protein, 10 aa, Homo Sapiens
LIVIISAIGL

SEQ ID NO: 2157 - protein, 10 aa, Homo Sapiens
YFILIGLPGL

SEQ ID NO: 2158 - protein, 10 aa, Homo Sapiens
LIGLPGLEEA

SEQ ID NO: 2159 - protein, 10 aa, Homo Sapiens
LAFPLCSLYL

SEQ ID NO: 2160 - protein, 10 aa, Homo Sapiens
RVTKIGVAAV

SEQ ID NO: 2161 - protein, 10 aa, Homo Sapiens
VAAVVRGAAL

SEQ ID NO: 2162 - protein, 10 aa, Homo Sapiens
QLPFCRSNIL

SEQ ID NO: 2163 - protein, 10 aa, Homo Sapiens
YCLHQDVMKL

SEQ ID NO: 2164 - protein, 10 aa, Homo Sapiens
LILKTVLGLT

SEQ ID NO: 2165 - protein, 10 aa, Homo Sapiens
GTCVSHVCAV

SEQ ID NO: 2166 - protein, 10 aa, Homo Sapiens
AVFIFYVPFI

SEQ ID NO: 2167 - protein, 10 aa, Homo Sapiens
FIFYVPFIGL

SEQ ID NO: 2168 - protein, 10 aa, Homo Sapiens
SPLPVILANI

SEQ ID NO: 2169 - protein, 10 aa, Homo Sapiens
NIYLLVPPVL

SEQ ID NO: 2170 - protein, 10 aa, Homo Sapiens
ILRLFHVATH

SEQ ID NO: 2171 - protein, 10 aa, Homo Sapiens
SATYFILIGL

SEQ ID NO: 2172 - protein, 10 aa, Homo Sapiens
ILIGLPGLEE

SEQ ID NO: 2173 - protein, 10 aa, Homo Sapiens
FWLAFPLCSL

SEQ ID NO: 2174 - protein, 10 aa, Homo Sapiens
SLYLIAVLGN

SEQ ID NO: 2175 - protein, 10 aa, Homo Sapiens
YLIAVLGNLT

SEQ ID NO: 2176 - protein, 10 aa, Homo Sapiens
NLTIIYIVRT

SEQ ID NO: 2177 - protein, 10 aa, Homo Sapiens
FLCMLSGIDI

SEQ ID NO: 2178 - protein, 10 aa, Homo Sapiens
MLAIFWFNST

SEQ ID NO: 2179 - protein, 10 aa, Homo Sapiens
APLPVFIKQL

SEQ ID NO: 2180 - protein, 10 aa, Homo Sapiens
LACDDIRVNV

SEQ ID NO: 2181 - protein, 10 aa, Homo Sapiens
SAIGLDSLLI

SEQ ID NO: 2182 - protein, 10 aa, Homo Sapiens
YVPFIGLSMV

SEQ ID NO: 2183 - protein, 10 aa, Homo Sapiens
ILANIYLLVP

SEQ ID NO: 2184 - protein, 10 aa, Homo Sapiens
YLLVPPVLNP

SEQ ID NO: 2185 - protein, 10 aa, Homo Sapiens
LVPPVLNPIV

SEQ ID NO: 2186 - protein, 10 aa, Homo Sapiens
PVLNPIVYGV

SEQ ID NO: 2187 - protein, 10 aa, Homo Sapiens
LCSLYLIAVL

SEQ ID NO: 2188 - protein, 10 aa, Homo Sapiens
LYLIAVLGNL

SEQ ID NO: 2189 - protein, 10 aa, Homo Sapiens
IAVLGNLTII

SEQ ID NO: 2190 - protein, 10 aa, Homo Sapiens
LGNLTIIYIV

SEQ ID NO: 2191 - protein, 10 aa, Homo Sapiens
CMLSGIDILI

SEQ ID NO: 2192 - protein, 10 aa, Homo Sapiens
GMESTVLLAM

SEQ ID NO: 2193 - protein, 10 aa, Homo Sapiens
ICHPLRHATV

SEQ ID NO: 2194 - protein, 10 aa, Homo Sapiens
HATVLTLPRV

SEQ ID NO: 2195 - protein, 10 aa, Homo Sapiens
GAALMAPLPV

SEQ ID NO: 2196 - protein, 10 aa, Homo Sapiens
LMAPLPVFIK

SEQ ID NO: 2197 - protein, 10 aa, Homo Sapiens
ACDDIRVNVV

SEQ ID NO: 2198 - protein, 10 aa, Homo Sapiens
GLTREAQAKA

SEQ ID NO: 2199 - protein, 10 aa, Homo Sapiens
HVCAVFIFYV

SEQ ID NO: 2200 - protein, 10 aa, Homo Sapiens
PVILANIYLL

SEQ ID NO: 2201 - protein, 10 aa, Homo Sapiens
ANIYLLVPPV

SEQ ID NO: 2202 - protein, 10 aa, Homo Sapiens
IVYGVKTKEI

SEQ ID NO: 2203 - protein, 10 aa, Homo Sapiens
KEIRQRILRL

SEQ ID NO: 2204 - protein, 10 aa, Homo Sapiens
IYIVRTEHSL

SEQ ID NO: 2205 - protein, 10 aa, Homo Sapiens
LCMLSGIDIL

SEQ ID NO: 2206 - protein, 10 aa, Homo Sapiens
MLSGIDILIS

SEQ ID NO: 2207 - protein, 10 aa, Homo Sapiens
LISTSSMPKM

SEQ ID NO: 2208 - protein, 10 aa, Homo Sapiens
STTIQFDACL

SEQ ID NO: 2209 - protein, 10 aa, Homo Sapiens
IQFDACLLQI

SEQ ID NO: 2210 - protein, 10 aa, Homo Sapiens
KLACDDIRVN

SEQ ID NO: 2211 - protein, 10 aa, Homo Sapiens
NVVYGLIVII

SEQ ID NO: 2212 - protein, 10 aa, Homo Sapiens
YGLIVIISAI

SEQ ID NO: 2213 - protein, 10 aa, Homo Sapiens
FSYLLILKTV

SEQ ID NO: 2214 - protein, 10 aa, Homo Sapiens
VLGLTREAQA

SEQ ID NO: 2215 - protein, 10 aa, Homo Sapiens
RILRLFHVAT

SEQ ID NO: 2216 - protein, 10 aa, Homo Sapiens
GLEEAQFWLA

SEQ ID NO: 2217 - protein, 10 aa, Homo Sapiens
TTIQFDACLL

SEQ ID NO: 2218 - protein, 10 aa, Homo Sapiens
DACLLQIFAI

SEQ ID NO: 2219 - protein, 10 aa, Homo Sapiens
AICHPLRHAT

SEQ ID NO: 2220 - protein, 10 aa, Homo Sapiens
VTKIGVAAVV

SEQ ID NO: 2221 - protein, 10 aa, Homo Sapiens
RVNVVYGLIV

SEQ ID NO: 2222 - protein, 10 aa, Homo Sapiens
YLLILKTVLG

SEQ ID NO: 2223 - protein, 10 aa, Homo Sapiens
KTKEIRQRIL

SEQ ID NO: 2224 - protein, 10 aa, Homo Sapiens
GLPGLEEAQF

SEQ ID NO: 2225 - protein, 10 aa, Homo Sapiens
AFPLCSLYLI

SEQ ID NO: 2226 - protein, 10 aa, Homo Sapiens
VAICHPLRHA

SEQ ID NO: 2227 - protein, 10 aa, Homo Sapiens
KIGVAAVVRG

SEQ ID NO: 2228 - protein, 10 aa, Homo Sapiens
SNILSHSYCL

SEQ ID NO: 2229 - protein, 10 aa, Homo Sapiens
GLIVIISAIG

SEQ ID NO: 2230 - protein, 10 aa, Homo Sapiens
AIGLDSLLIS

SEQ ID NO: 2231 - protein, 10 aa, Homo Sapiens
GLDSLLISFS

SEQ ID NO: 2232 - protein, 10 aa, Homo Sapiens
KRRDSPLPVI

SEQ ID NO: 2233 - protein, 10 aa, Homo Sapiens
PRVTKIGVAA

SEQ ID NO: 2234 - protein, 10 aa, Homo Sapiens
GVAAVVRGAA

SEQ ID NO: 2235 - protein, 10 aa, Homo Sapiens
MESTVLLAMA

SEQ ID NO: 2236 - protein, 10 aa, Homo Sapiens
VLGLTREAQA

SEQ ID NO: 2237 - protein, 10 aa, Homo Sapiens
GLTREAQAKA

SEQ ID NO: 2238 - protein, 10 aa, Homo Sapiens
RVTKIGVAAV

SEQ ID NO: 2239 - protein, 10 aa, Homo Sapiens
VAAVVRGAAL

SEQ ID NO: 2240 - protein, 10 aa, Homo Sapiens
VDPNGNESSA

SEQ ID NO: 2241 - protein, 10 aa, Homo Sapiens
LIGLPGLEEA

SEQ ID NO: 2242 - protein, 10 aa, Homo Sapiens
GLEEAQFWLA

SEQ ID NO: 2243 - protein, 10 aa, Homo Sapiens
FPLCSLYLIA

SEQ ID NO: 2244 - protein, 10 aa, Homo Sapiens
STSSMPKMLA

SEQ ID NO: 2245 - protein, 10 aa, Homo Sapiens
FNSTTIQFDA

SEQ ID NO: 2246 - protein, 10 aa, Homo Sapiens
FDACLLQIFA

SEQ ID NO: 2247 - protein, 10 aa, Homo Sapiens
SGMESTVLLA

SEQ ID NO: 2248 - protein, 10 aa, Homo Sapiens
LAMAFDRYVA

SEQ ID NO: 2249 - protein, 10 aa, Homo Sapiens
VAICHPLRHA

SEQ ID NO: 2250 - protein, 10 aa, Homo Sapiens
LPRVTKIGVA

SEQ ID NO: 2251 - protein, 10 aa, Homo Sapiens
IGVAAVVRGA

SEQ ID NO: 2252 - protein, 10 aa, Homo Sapiens
AVVRGAALMA

SEQ ID NO: 2253 - protein, 10 aa, Homo Sapiens
CLHQDVMKLA

SEQ ID NO: 2254 - protein, 10 aa, Homo Sapiens
VYGLIVIISA

SEQ ID NO: 2255 - protein, 10 aa, Homo Sapiens
KTVLGLTREA

SEQ ID NO: 2256 - protein, 10 aa, Homo Sapiens
FGTCVSHVCA

SEQ ID NO: 2257 - protein, 10 aa, Homo Sapiens
RDSPLPVILA

SEQ ID NO: 2258 - protein, 10 aa, Homo Sapiens
QRILRLFHVA

SEQ ID NO: 2259 - protein, 10 aa, Homo Sapiens
LRLFHVATHA

SEQ ID NO: 2260 - protein, 10 aa, Homo Sapiens
DPNGNESSAT

SEQ ID NO: 2261 - protein, 10 aa, Homo Sapiens
IGLPGLEEAQ

SEQ ID NO: 2262 - protein, 10 aa, Homo Sapiens
LEEAQFWLAF

SEQ ID NO: 2263 - protein, 10 aa, Homo Sapiens
PLCSLYLIAV

SEQ ID NO: 2264 - protein, 10 aa, Homo Sapiens
TSSMPKMLAI

SEQ ID NO: 2265 - protein, 10 aa, Homo Sapiens
NSTTIQFDAC

SEQ ID NO: 2266 - protein, 10 aa, Homo Sapiens
DACLLQIFAI

SEQ ID NO: 2267 - protein, 10 aa, Homo Sapiens
GMESTVLLAM

SEQ ID NO: 2268 - protein, 10 aa, Homo Sapiens
ESTVLLAMAF

SEQ ID NO: 2269 - protein, 10 aa, Homo Sapiens
AMAFDRYVAI

SEQ ID NO: 2270 - protein, 10 aa, Homo Sapiens
AICHPLRHAT

SEQ ID NO: 2271 - protein, 10 aa, Homo Sapiens
VVRGAALMAP

SEQ ID NO: 2272 - protein, 10 aa, Homo Sapiens
LHQDVMKLAC

SEQ ID NO: 2273 - protein, 10 aa, Homo Sapiens
YGLIVIISAI

SEQ ID NO: 2274 - protein, 10 aa, Homo Sapiens
TVLGLTREAQ

SEQ ID NO: 2275 - protein, 10 aa, Homo Sapiens
LGLTREAQAK

SEQ ID NO: 2276 - protein, 10 aa, Homo Sapiens
LTREAQAKAF

SEQ ID NO: 2277 - protein, 10 aa, Homo Sapiens
GTCVSHVCAV

SEQ ID NO: 2278 - protein, 10 aa, Homo Sapiens
DSPLPVILAN

SEQ ID NO: 2279 - protein, 10 aa, Homo Sapiens
RILRLFHVAT

SEQ ID NO: 2280 - protein, 10 aa, Homo Sapiens
RLFHVATHAS

SEQ ID NO: 2281 - protein, 10 aa, Homo Sapiens
EIRQRILRLF

SEQ ID NO: 2282 - protein, 10 aa, Homo Sapiens
DIRVNVVYGL

SEQ ID NO: 2283 - protein, 10 aa, Homo Sapiens
FIFYVPFIGL

SEQ ID NO: 2284 - protein, 10 aa, Homo Sapiens
FIGLSMVHRF

SEQ ID NO: 2285 - protein, 10 aa, Homo Sapiens
LISTSSMPKM

SEQ ID NO: 2286 - protein, 10 aa, Homo Sapiens
PVILANIYLL

SEQ ID NO: 2287 - protein, 10 aa, Homo Sapiens
GLPGLEEAQF

SEQ ID NO: 2288 - protein, 10 aa, Homo Sapiens
VLLAMAFDRY

SEQ ID NO: 2289 - protein, 10 aa, Homo Sapiens
IISAIGLDSL

SEQ ID NO: 2290 - protein, 10 aa, Homo Sapiens
LLILKTVLGL

SEQ ID NO: 2291 - protein, 10 aa, Homo Sapiens
LTREAQAKAF

SEQ ID NO: 2292 - protein, 10 aa, Homo Sapiens
YFILIGLPGL

SEQ ID NO: 2293 - protein, 10 aa, Homo Sapiens
AVLGNLTIIY

SEQ ID NO: 2294 - protein, 10 aa, Homo Sapiens
SLHEPMYIFL

SEQ ID NO: 2295 - protein, 10 aa, Homo Sapiens
QFDACLLQIF

SEQ ID NO: 2296 - protein, 10 aa, Homo Sapiens
LISFSYLLIL

SEQ ID NO: 2297 - protein, 10 aa, Homo Sapiens
TTIQFDACLL

SEQ ID NO: 2298 - protein, 10 aa, Homo Sapiens
LLQIFAIHSL

SEQ ID NO: 2299 - protein, 10 aa, Homo Sapiens
IFAIHSLSGM

SEQ ID NO: 2300 - protein, 10 aa, Homo Sapiens
KTKEIRQRIL

SEQ ID NO: 2301 - protein, 10 aa, Homo Sapiens
WLAFPLCSLY

SEQ ID NO: 2302 - protein, 10 aa, Homo Sapiens
PLRHATVLTL

SEQ ID NO: 2303 - protein, 10 aa, Homo Sapiens
EPMYIFLCML

SEQ ID NO: 2304 - protein, 10 aa, Homo Sapiens
STTIQFDACL

SEQ ID NO: 2305 - protein, 10 aa, Homo Sapiens
LIVIISAIGL

SEQ ID NO: 2306 - protein, 10 aa, Homo Sapiens
DSLLISFSYL

SEQ ID NO: 2307 - protein, 10 aa, Homo Sapiens
PLPVILANIY

SEQ ID NO: 2308 - protein, 10 aa, Homo Sapiens
NIYLLVPPVL

SEQ ID NO: 2309 - protein, 10 aa, Homo Sapiens
RTEHSLHEPM

SEQ ID NO: 2310 - protein, 10 aa, Homo Sapiens
YIFLCMLSGI

SEQ ID NO: 2311 - protein, 10 aa, Homo Sapiens
DILISTSSMP

SEQ ID NO: 2312 - protein, 10 aa, Homo Sapiens
SLSGMESTVL

SEQ ID NO: 2313 - protein, 10 aa, Homo Sapiens
ESTVLLAMAF

SEQ ID NO: 2314 - protein, 10 aa, Homo Sapiens
VVRGAALMAP

SEQ ID NO: 2315 - protein, 10 aa, Homo Sapiens
SSMPKMLAIF

SEQ ID NO: 2316 - protein, 10 aa, Homo Sapiens
RVTKIGVAAV

SEQ ID NO: 2317 - protein, 10 aa, Homo Sapiens
PVFIKQLPFC

SEQ ID NO: 2318 - protein, 10 aa, Homo Sapiens
FIKQLPFCRS

SEQ ID NO: 2319 - protein, 10 aa, Homo Sapiens
QLPFCRSNIL

SEQ ID NO: 2320 - protein, 10 aa, Homo Sapiens
DVMKLACDDI

SEQ ID NO: 2321 - protein, 10 aa, Homo Sapiens
AVFIFYVPFI

SEQ ID NO: 2322 - protein, 10 aa, Homo Sapiens
YVPFIGLSMV

SEQ ID NO: 2323 - protein, 10 aa, Homo Sapiens
LTIIYIVRTE

SEQ ID NO: 2324 - protein, 10 aa, Homo Sapiens
KIGVAAVVRG

SEQ ID NO: 2325 - protein, 10 aa, Homo Sapiens
VVYGLIVIIS

SEQ ID NO: 2326 - protein, 10 aa, Homo Sapiens
IVIISAIGLD

SEQ ID NO: 2327 - protein, 10 aa, Homo Sapiens
IGLDSLLISF

SEQ ID NO: 2328 - protein, 10 aa, Homo Sapiens
SLLISFSYLL

SEQ ID NO: 2329 - protein, 10 aa, Homo Sapiens
PFIGLSMVHR

SEQ ID NO: 2330 - protein, 10 aa, Homo Sapiens
RFSKRRDSPL

SEQ ID NO: 2331 - protein, 10 aa, Homo Sapiens
GVKTKEIRQR

SEQ ID NO: 2332 - protein, 10 aa, Homo Sapiens
LIGLPGLEEA

SEQ ID NO: 2333 - protein, 10 aa, Homo Sapiens
MPKMLAIFWF

SEQ ID NO: 2334 - protein, 10 aa, Homo Sapiens
STVLLAMAFD

SEQ ID NO: 2335 - protein, 10 aa, Homo Sapiens
AALMAPLPVF

SEQ ID NO: 2336 - protein, 10 aa, Homo Sapiens
APLPVFIKQL

SEQ ID NO: 2337 - protein, 10 aa, Homo Sapiens
NILSHSYCLH

SEQ ID NO: 2338 - protein, 10 aa, Homo Sapiens
NVVYGLIVII

SEQ ID NO: 2339 - protein, 10 aa, Homo Sapiens
GLDSLLISFS

SEQ ID NO: 2340 - protein, 10 aa, Homo Sapiens
LLISFSYLLI

SEQ ID NO: 2341 - protein, 10 aa, Homo Sapiens
LILKTVLGLT

SEQ ID NO: 2342 - protein, 10 aa, Homo Sapiens
GTCVSHVCAV

SEQ ID NO: 2343 - protein, 10 aa, Homo Sapiens
CAVFIFYVPF

SEQ ID NO: 2344 - protein, 10 aa, Homo Sapiens
PVLNPIVYGV

SEQ ID NO: 2345 - protein, 10 aa, Homo Sapiens
KEIRQRILRL

SEQ ID NO: 2346 - protein, 10 aa, Homo Sapiens
TVLTLPRVTK

SEQ ID NO: 2347 - protein, 10 aa, Homo Sapiens
VLNPIVYGVK

SEQ ID NO: 2348 - protein, 10 aa, Homo Sapiens
ILKTVLGLTR

SEQ ID NO: 2349 - protein, 10 aa, Homo Sapiens
ILRLFHVATH

SEQ ID NO: 2350 - protein, 10 aa, Homo Sapiens
ILISTSSMPK

SEQ ID NO: 2351 - protein, 10 aa, Homo Sapiens
ILIGLPGLEE

SEQ ID NO: 2352 - protein, 10 aa, Homo Sapiens
AVLGNLTIIY

SEQ ID NO: 2353 - protein, 10 aa, Homo Sapiens
AVVRGAALMA

SEQ ID NO: 2354 - protein, 10 aa, Homo Sapiens
GLSMVHRFSK

SEQ ID NO: 2355 - protein, 10 aa, Homo Sapiens
GLPGLEEAQF

SEQ ID NO: 2356 - protein, 10 aa, Homo Sapiens
RILRLFHVAT

SEQ ID NO: 2357 - protein, 10 aa, Homo Sapiens
ILANIYLLVP

SEQ ID NO: 2358 - protein, 10 aa, Homo Sapiens
WLAFPLCSLY

SEQ ID NO: 2359 - protein, 10 aa, Homo Sapiens
TVLLAMAFDR

SEQ ID NO: 2360 - protein, 10 aa, Homo Sapiens
VLLAMAFDRY

SEQ ID NO: 2361 - protein, 10 aa, Homo Sapiens
YVAICHPLRH

SEQ ID NO: 2362 - protein, 10 aa, Homo Sapiens
PLRHATVLTL

SEQ ID NO: 2363 - protein, 10 aa, Homo Sapiens
TKIGVAAVVR

SEQ ID NO: 2364 - protein, 10 aa, Homo Sapiens
ALMAPLPVFI

SEQ ID NO: 2365 - protein, 10 aa, Homo Sapiens
RVNVVYGLIV

SEQ ID NO: 2366 - protein, 10 aa, Homo Sapiens
SLYLIAVLGN

SEQ ID NO: 2367 - protein, 10 aa, Homo Sapiens
PLPVILANIY

SEQ ID NO: 2368 - protein, 10 aa, Homo Sapiens
YLIAVLGNLT

SEQ ID NO: 2369 - protein, 10 aa, Homo Sapiens
YIVRTEHSLH

SEQ ID NO: 2370 - protein, 10 aa, Homo Sapiens
IVRTEHSLHE

SEQ ID NO: 2371 - protein, 10 aa, Homo Sapiens
SLSGMESTVL

SEQ ID NO: 2372 - protein, 10 aa, Homo Sapiens
RVTKIGVAAV

SEQ ID NO: 2373 - protein, 10 aa, Homo Sapiens
KLACDDIRVN

SEQ ID NO: 2374 - protein, 10 aa, Homo Sapiens
NIYLLVPPVL

SEQ ID NO: 2375 - protein, 10 aa, Homo Sapiens
IVYGVKTKEI

SEQ ID NO: 2376 - protein, 10 aa, Homo Sapiens
GVKTKEIRQR

SEQ ID NO: 2377 - protein, 10 aa, Homo Sapiens
TIIYIVRTEH

SEQ ID NO: 2378 - protein, 10 aa, Homo Sapiens
QIFAIHSLSG

SEQ ID NO: 2379 - protein, 10 aa, Homo Sapiens
VVRGAALMAP

SEQ ID NO: 2380 - protein, 10 aa, Homo Sapiens
SYCLHQDVMK

SEQ ID NO: 2381 - protein, 10 aa, Homo Sapiens
IVIISAIGLD

SEQ ID NO: 2382 - protein, 10 aa, Homo Sapiens
VIISAIGLDS

SEQ ID NO: 2383 - protein, 10 aa, Homo Sapiens
YLLILKTVLG

SEQ ID NO: 2384 - protein, 10 aa, Homo Sapiens
LLILKTVLGL

SEQ ID NO: 2385 - protein, 10 aa, Homo Sapiens
VLGLTREAQA

SEQ ID NO: 2386 - protein, 10 aa, Homo Sapiens
CVSHVCAVFI

SEQ ID NO: 2387 - protein, 10 aa, Homo Sapiens
NPIVYGVKTK

SEQ ID NO: 2388 - protein, 10 aa, Homo Sapiens
LIAVLGNLTI

SEQ ID NO: 2389 - protein, 10 aa, Homo Sapiens
AIFWFNSTTI

SEQ ID NO: 2390 - protein, 10 aa, Homo Sapiens
GVAAVVRGAA

SEQ ID NO: 2391 - protein, 10 aa, Homo Sapiens
VVYGLIVIIS

SEQ ID NO: 2392 - protein, 10 aa, Homo Sapiens
GLIVIISAIG

SEQ ID NO: 2393 - protein, 10 aa, Homo Sapiens
LLISFSYLLI

SEQ ID NO: 2394 - protein, 10 aa, Homo Sapiens
TVLGLTREAQ

SEQ ID NO: 2395 - protein, 10 aa, Homo Sapiens
LGLTREAQAK

SEQ ID NO: 2396 - protein, 10 aa, Homo Sapiens
GLTREAQAKA

SEQ ID NO: 2397 - protein, 10 aa, Homo Sapiens
MVDPNGNESS

SEQ ID NO: 2398 - protein, 10 aa, Homo Sapiens
NLTIIYIVRT

SEQ ID NO: 2399 - protein, 10 aa, Homo Sapiens
IIYIVRTEHS

SEQ ID NO: 2400 - protein, 10 aa, Homo Sapiens
MLSGIDILIS

SEQ ID NO: 2401 - protein, 10 aa, Homo Sapiens
DILISTSSMP

SEQ ID NO: 2402 - protein, 10 aa, Homo Sapiens
CLLQIFAIHS

SEQ ID NO: 2403 - protein, 10 aa, Homo Sapiens
AIHSLSGMES

SEQ ID NO: 2404 - protein, 10 aa, Homo Sapiens
KIGVAAVVRG

SEQ ID NO: 2405 - protein, 10 aa, Homo Sapiens
ILSHSYCLHQ

SEQ ID NO: 2406 - protein, 10 aa, Homo Sapiens
CDDIRVNVVY

SEQ ID NO: 2407 - protein, 10 aa, Homo Sapiens
AIGLDSLLIS

SEQ ID NO: 2408 - protein, 10 aa, Homo Sapiens
VILANIYLLV

SEQ ID NO: 2409 - protein, 10 aa, Homo Sapiens
YLLVPPVLNP

SEQ ID NO: 2410 - protein, 10 aa, Homo Sapiens
EIRQRILRLF

SEQ ID NO: 2411 - protein, 10 aa, Homo Sapiens
RLFHVATHAS

SEQ ID NO: 2412 - protein, 10 aa, Homo Sapiens
APLPVFIKQL

SEQ ID NO: 2413 - protein, 10 aa, Homo Sapiens
EPMYIFLCML

SEQ ID NO: 2414 - protein, 10 aa, Homo Sapiens
LPVILANIYL

SEQ ID NO: 2415 - protein, 10 aa, Homo Sapiens
DPNGNESSAT

SEQ ID NO: 2416 - protein, 10 aa, Homo Sapiens
HPLRHATVLT

SEQ ID NO: 2417 - protein, 10 aa, Homo Sapiens
LPRVTKIGVA

SEQ ID NO: 2418 - protein, 10 aa, Homo Sapiens
LPVFIKQLPF

SEQ ID NO: 2419 - protein, 10 aa, Homo Sapiens
FPLCSLYLIA

SEQ ID NO: 2420 - protein, 10 aa, Homo Sapiens
SPLPVILANI

SEQ ID NO: 2421 - protein, 10 aa, Homo Sapiens
MPKMLAIFWF

SEQ ID NO: 2422 - protein, 10 aa, Homo Sapiens
SLSGMESTVL

SEQ ID NO: 2423 - protein, 10 aa, Homo Sapiens
PLRHATVLTL

SEQ ID NO: 2424 - protein, 10 aa, Homo Sapiens
RFSKRRDSPL

SEQ ID NO: 2425 - protein, 10 aa, Homo Sapiens
LCSLYLIAVL

SEQ ID NO: 2426 - protein, 10 aa, Homo Sapiens
LSGMESTVLL

SEQ ID NO: 2427 - protein, 10 aa, Homo Sapiens
VRGAALMAPL

SEQ ID NO: 2428 - protein, 10 aa, Homo Sapiens
IISAIGLDSL

SEQ ID NO: 2429 - protein, 10 aa, Homo Sapiens
LISFSYLLIL

SEQ ID NO: 2430 - protein, 10 aa, Homo Sapiens
RRDSPLPVIL

SEQ ID NO: 2431 - protein, 10 aa, Homo Sapiens
LAFPLCSLYL

SEQ ID NO: 2432 - protein, 10 aa, Homo Sapiens
VAAVVRGAAL

SEQ ID NO: 2433 - protein, 10 aa, Homo Sapiens
ALMAPLPVFI

SEQ ID NO: 2434 - protein, 10 aa, Homo Sapiens
DIRVNVVYGL

SEQ ID NO: 2435 - protein, 10 aa, Homo Sapiens
LLILKTVLGL

SEQ ID NO: 2436 - protein, 10 aa, Homo Sapiens
KEIRQRILRL

SEQ ID NO: 2437 - protein, 10 aa, Homo Sapiens
NESSATYFIL

SEQ ID NO: 2438 - protein, 10 aa, Homo Sapiens
LPGLEEAQFW

SEQ ID NO: 2439 - protein, 10 aa, Homo Sapiens
EAQFWLAFPL

SEQ ID NO: 2440 - protein, 10 aa, Homo Sapiens
AMAFDRYVAI

SEQ ID NO: 2441 - protein, 10 aa, Homo Sapiens
CHPLRHATVL

SEQ ID NO: 2442 - protein, 10 aa, Homo Sapiens
ISAIGLDSLL

SEQ ID NO: 2443 - protein, 10 aa, Homo Sapiens
SYLLILKTVL

SEQ ID NO: 2444 - protein, 10 aa, Homo Sapiens
NIYLLVPPVL

SEQ ID NO: 2445 - protein, 10 aa, Homo Sapiens
PPVLNPIVYG

SEQ ID NO: 2446 - protein, 10 aa, Homo Sapiens
ESSATYFILI

SEQ ID NO: 2447 - protein, 10 aa, Homo Sapiens
YFILIGLPGL

SEQ ID NO: 2448 - protein, 10 aa, Homo Sapiens
FWLAFPLCSL

SEQ ID NO: 2449 - protein, 10 aa, Homo Sapiens
IYIVRTEHSL

SEQ ID NO: 2450 - protein, 10 aa, Homo Sapiens
SLHEPMYIFL

SEQ ID NO: 2451 - protein, 10 aa, Homo Sapiens
LCMLSGIDIL

SEQ ID NO: 2452 - protein, 10 aa, Homo Sapiens
ISTSSMPKML

SEQ ID NO: 2453 - protein, 10 aa, Homo Sapiens
TSSMPKMLAI

SEQ ID NO: 2454 - protein, 10 aa, Homo Sapiens
STTIQFDACL

SEQ ID NO: 2455 - protein, 10 aa, Homo Sapiens
DRYVAICHPL

SEQ ID NO: 2456 - protein, 10 aa, Homo Sapiens
RVTKIGVAAV

SEQ ID NO: 2457 - protein, 10 aa, Homo Sapiens
YCLHQDVMKL

SEQ ID NO: 2458 - protein, 10 aa, Homo Sapiens
ACDDIRVNVV

SEQ ID NO: 2459 - protein, 10 aa, Homo Sapiens
DSLLISFSYL

SEQ ID NO: 2460 - protein, 10 aa, Homo Sapiens
AQAKAFGTCV

SEQ ID NO: 2461 - protein, 10 aa, Homo Sapiens
CVSHVCAVFI

SEQ ID NO: 2462 - protein, 10 aa, Homo Sapiens
AVFIFYVPFI

SEQ ID NO: 2463 - protein, 10 aa, Homo Sapiens
FIFYVPFIGL

SEQ ID NO: 2464 - protein, 10 aa, Homo Sapiens
VPFIGLSMVH

SEQ ID NO: 2465 - protein, 10 aa, Homo Sapiens
SKRRDSPLPV

SEQ ID NO: 2466 - protein, 10 aa, Homo Sapiens
KRRDSPLPVI

SEQ ID NO: 2467 - protein, 10 aa, Homo Sapiens
RDSPLPVILA

SEQ ID NO: 2468 - protein, 10 aa, Homo Sapiens
ANIYLLVPPV

SEQ ID NO: 2469 - protein, 10 aa, Homo Sapiens
VPPVLNPIVY

SEQ ID NO: 2470 - protein, 10 aa, Homo Sapiens
NPIVYGVKTK

SEQ ID NO: 2471 - protein, 10 aa, Homo Sapiens
KTKEIRQRIL

SEQ ID NO: 2472 - protein, 15 aa, Homo Sapiens
YGLIVIISAIGLDSL

SEQ ID NO: 2473 - protein, 15 aa, Homo Sapiens
LSGIDILISTSSMPK

SEQ ID NO: 2474 - protein, 15 aa, Homo Sapiens
YIFLCMLSGIDILIS

SEQ ID NO: 2475 - protein, 15 aa, Homo Sapiens
IFAIHSLSGMESTVL

SEQ ID NO: 2476 - protein, 15 aa, Homo Sapiens
LTIIYIVRTEHSLHE

SEQ ID NO: 2477 - protein, 15 aa, Homo Sapiens
DIRVNVVYGLIVIIS

SEQ ID NO: 2478 - protein, 15 aa, Homo Sapiens
LANIYLLVPPVLNPI

SEQ ID NO: 2479 - protein, 15 aa, Homo Sapiens
DACLLQIFAIHSLSG

SEQ ID NO: 2480 - protein, 15 aa, Homo Sapiens
IHSLSGMESTVLLAM

SEQ ID NO: 2481 - protein, 15 aa, Homo Sapiens
GTCVSHVCAVFIFYV

SEQ ID NO: 2482 - protein, 15 aa, Homo Sapiens
SATYFILIGLPGLEE

SEQ ID NO: 2483 - protein, 15 aa, Homo Sapiens
NPIVYGVKTKEIRQR

SEQ ID NO: 2484 - protein, 15 aa, Homo Sapiens
ATYFILIGLPGLEEA

SEQ ID NO: 2485 - protein, 15 aa, Homo Sapiens
FIFYVPFIGLSMVHR

SEQ ID NO: 2486 - protein, 15 aa, Homo Sapiens
LPRVTKIGVAAVVRG

SEQ ID NO: 2487 - protein, 15 aa, Homo Sapiens
HQDVMKLACDDIRVN

SEQ ID NO: 2488 - protein, 15 aa, Homo Sapiens
SFSYLLILKTVLGLT

SEQ ID NO: 2489 - protein, 15 aa, Homo Sapiens
LIGLPGLEEAQFWLA

SEQ ID NO: 2490 - protein, 15 aa, Homo Sapiens
EAQFWLAFPLCSLYL

SEQ ID NO: 2491 - protein, 15 aa, Homo Sapiens
LYLIAVLGNLTIIYI

SEQ ID NO: 2492 - protein, 15 aa, Homo Sapiens
GIDILISTSSMPKML

SEQ ID NO: 2493 - protein, 15 aa, Homo Sapiens
GMESTVLLAMAFDRY

SEQ ID NO: 2494 - protein, 15 aa, Homo Sapiens
VAAVVRGAALMAPLP

SEQ ID NO: 2495 - protein, 15 aa, Homo Sapiens
PVFIKQLPFCRSNIL

SEQ ID NO: 2496 - protein, 15 aa, Homo Sapiens
NVVYGLIVIISAIGL

SEQ ID NO: 2497 - protein, 15 aa, Homo Sapiens
LDSLLISFSYLLILK

SEQ ID NO: 2498 - protein, 15 aa, Homo Sapiens
FSYLLILKTVLGLTR

SEQ ID NO: 2499 - protein, 15 aa, Homo Sapiens
YFILIGLPGLEEAQF

SEQ ID NO: 2500 - protein, 15 aa, Homo Sapiens
AFPLCSLYLIAVLGN

SEQ ID NO: 2501 - protein, 15 aa, Homo Sapiens
IAVLGNLTIIYIVRT

SEQ ID NO: 2502 - protein, 15 aa, Homo Sapiens
TSSMPKMLAIFWFNS

SEQ ID NO: 2503 - protein, 15 aa, Homo Sapiens
AIFWFNSTTIQFDAC

SEQ ID NO: 2504 - protein, 15 aa, Homo Sapiens
VLTLPRVTKIGVAAV

SEQ ID NO: 2505 - protein, 15 aa, Homo Sapiens
VVRGAALMAPLPVFI

SEQ ID NO: 2506 - protein, 15 aa, Homo Sapiens
LPVFIKQLPFCRSNI

SEQ ID NO: 2507 - protein, 15 aa, Homo Sapiens
VNVVYGLIVIISAIG

SEQ ID NO: 2508 - protein, 15 aa, Homo Sapiens
LIVIISAIGLDSLLI

SEQ ID NO: 2509 - protein, 15 aa, Homo Sapiens
AIGLDSLLISFSYLL

SEQ ID NO: 2510 - protein, 15 aa, Homo Sapiens
AVFIFYVPFIGLSMV

SEQ ID NO: 2511 - protein, 15 aa, Homo Sapiens
IFYVPFIGLSMVHRF

SEQ ID NO: 2512 - protein, 15 aa, Homo Sapiens
MLAIFWFNSTTIQFD

SEQ ID NO: 2513 - protein, 15 aa, Homo Sapiens
LQIFAIHSLSGMEST

SEQ ID NO: 2514 - protein, 15 aa, Homo Sapiens
IKQLPFCRSNILSHS

SEQ ID NO: 2515 - protein, 15 aa, Homo Sapiens
IVIISAIGLDSLLIS

SEQ ID NO: 2516 - protein, 15 aa, Homo Sapiens
LLILKTVLGLTREAQ

SEQ ID NO: 2517 - protein, 15 aa, Homo Sapiens
ANIYLLVPPVLNPIV

SEQ ID NO: 2518 - protein, 15 aa, Homo Sapiens
FWLAFPLCSLYLIAV

SEQ ID NO: 2519 - protein, 15 aa, Homo Sapiens
SLYLIAVLGNLTIIY

SEQ ID NO: 2520 - protein, 15 aa, Homo Sapiens
MYIFLCMLSGIDILI

SEQ ID NO: 2521 - protein, 15 aa, Homo Sapiens
LCMLSGIDILISTSS

SEQ ID NO: 2522 - protein, 15 aa, Homo Sapiens
MPKMLAIFWFNSTTI

SEQ ID NO: 2523 - protein, 15 aa, Homo Sapiens
KIGVAAVVRGAALMA

SEQ ID NO: 2524 - protein, 15 aa, Homo Sapiens
IGVAAVVRGAALMAP

SEQ ID NO: 2525 - protein, 15 aa, Homo Sapiens
GAALMAPLPVFIKQL

SEQ ID NO: 2526 - protein, 15 aa, Homo Sapiens
IISAIGLDSLLISFS

SEQ ID NO: 2527 - protein, 15 aa, Homo Sapiens
VSHVCAVFIFYVPFI

SEQ ID NO: 2528 - protein, 15 aa, Homo Sapiens
DSPLPVILANIYLLV

SEQ ID NO: 2529 - protein, 15 aa, Homo Sapiens
PVILANIYLLVPPVL

SEQ ID NO: 2530 - protein, 15 aa, Homo Sapiens
YLLVPPVLNPIVYGV

SEQ ID NO: 2531 - protein, 15 aa, Homo Sapiens
CSLYLIAVLGNLTII

SEQ ID NO: 2532 - protein, 15 aa, Homo Sapiens
SGIDILISTSSMPKM

SEQ ID NO: 2533 - protein, 15 aa, Homo Sapiens
VRGAALMAPLPVFIK

SEQ ID NO: 2534 - protein, 15 aa, Homo Sapiens
EIRQRILRLFHVATH

SEQ ID NO: 2535 - protein, 15 aa, Homo Sapiens
LLQIFAIHSLSGMES

SEQ ID NO: 2536 - protein, 15 aa, Homo Sapiens
ATVLTLPRVTKIGVA

SEQ ID NO: 2537 - protein, 15 aa, Homo Sapiens
PRVTKIGVAAVVRGA

SEQ ID NO: 2538 - protein, 15 aa, Homo Sapiens
CDDIRVNVVYGLIVI

SEQ ID NO: 2539 - protein, 15 aa, Homo Sapiens
VYGLIVIISAIGLDS

SEQ ID NO: 2540 - protein, 15 aa, Homo Sapiens
VHRFSKRRDSPLPVI

SEQ ID NO: 2541 - protein, 15 aa, Homo Sapiens
SPLPVILANIYLLVP

SEQ ID NO: 2542 - protein, 15 aa, Homo Sapiens
WLAFPLCSLYLIAVL

SEQ ID NO: 2543 - protein, 15 aa, Homo Sapiens
HEPMYIFLCMLSGID

SEQ ID NO: 2544 - protein, 15 aa, Homo Sapiens
EPMYIFLCMLSGIDI

SEQ ID NO: 2545 - protein, 15 aa, Homo Sapiens
PMYIFLCMLSGIDIL

SEQ ID NO: 2546 - protein, 15 aa, Homo Sapiens
ACLLQIFAIHSLSGM

SEQ ID NO: 2547 - protein, 15 aa, Homo Sapiens
LISFSYLLILKTVLG

SEQ ID NO: 2548 - protein, 15 aa, Homo Sapiens
SYLLILKTVLGLTRE

SEQ ID NO: 2549 - protein, 15 aa, Homo Sapiens
LGLTREAQAKAFGTC

SEQ ID NO: 2550 - protein, 15 aa, Homo Sapiens
REAQAKAFGTCVSHV

SEQ ID NO: 2551 - protein, 15 aa, Homo Sapiens
VCAVFIFYVPFIGLS

SEQ ID NO: 2552 - protein, 15 aa, Homo Sapiens
TKEIRQRILRLFHVA

SEQ ID NO: 2553 - protein, 15 aa, Homo Sapiens
DPNGNESSATYFILI

SEQ ID NO: 2554 - protein, 15 aa, Homo Sapiens
FILIGLPGLEEAQFW

SEQ ID NO: 2555 - protein, 15 aa, Homo Sapiens
AQFWLAFPLCSLYLI

SEQ ID NO: 2556 - protein, 15 aa, Homo Sapiens
LGNLTIIYIVRTEHS

SEQ ID NO: 2557 - protein, 15 aa, Homo Sapiens
TIIYIVRTEHSLHEP

SEQ ID NO: 2558 - protein, 15 aa, Homo Sapiens
SSMPKMLAIFWFNST

SEQ ID NO: 2559 - protein, 15 aa, Homo Sapiens
LAIFWFNSTTIQFDA

SEQ ID NO: 2560 - protein, 15 aa, Homo Sapiens
FNSTTIQFDACLLQI

SEQ ID NO: 2561 - protein, 15 aa, Homo Sapiens
TIQFDACLLQIFAIH

SEQ ID NO: 2562 - protein, 15 aa, Homo Sapiens
TVLLAMAFDRYVAIC

SEQ ID NO: 2563 - protein, 15 aa, Homo Sapiens
AMAFDRYVAICHPLR

SEQ ID NO: 2564 - protein, 15 aa, Homo Sapiens
AICHPLRHATVLTLP

SEQ ID NO: 2565 - protein, 15 aa, Homo Sapiens
CHPLRHATVLTLPRV

SEQ ID NO: 2566 - protein, 15 aa, Homo Sapiens
GVAAVVRGAALMAPL

SEQ ID NO: 2567 - protein, 15 aa, Homo Sapiens
AAVVRGAALMAPLPV

SEQ ID NO: 2568 - protein, 15 aa, Homo Sapiens
ISFSYLLILKTVLGL

SEQ ID NO: 2569 - protein, 15 aa, Homo Sapiens
VLGLTREAQAKAFGT

SEQ ID NO: 2570 - protein, 15 aa, Homo Sapiens
VFIFYVPFIGLSMVH

SEQ ID NO: 2571 - protein, 15 aa, Homo Sapiens
YVPFIGLSMVHRFSK

SEQ ID NO: 2572 - protein, 15 aa, Homo Sapiens
VPPVLNPIVYGVKTK

SEQ ID NO: 2573 - protein, 15 aa, Homo Sapiens
PVLNPIVYGVKTKEI

SEQ ID NO: 2574 - protein, 15 aa, Homo Sapiens
RILRLFHVATHASEP

SEQ ID NO: 2575 - protein, 15 aa, Homo Sapiens
LIGLPGLEEAQFWLA

SEQ ID NO: 2576 - protein, 15 aa, Homo Sapiens
ISAIGLDSLLISFSY

SEQ ID NO: 2577 - protein, 15 aa, Homo Sapiens
STTIQFDACLLQIFA

SEQ ID NO: 2578 - protein, 15 aa, Homo Sapiens
LLAMAFDRYVAICHP

SEQ ID NO: 2579 - protein, 15 aa, Homo Sapiens
LIAVLGNLTIIYIVR

SEQ ID NO: 2580 - protein, 15 aa, Homo Sapiens
SYCLHQDVMKLACDD

SEQ ID NO: 2581 - protein, 15 aa, Homo Sapiens
LDSLLISFSYLLILK

SEQ ID NO: 2582 - protein, 15 aa, Homo Sapiens
SYLLILKTVLGLTRE

SEQ ID NO: 2583 - protein, 15 aa, Homo Sapiens
PLPVILANIYLLVPP

SEQ ID NO: 2584 - protein, 15 aa, Homo Sapiens
QFWLAFPLCSLYLIA

SEQ ID NO: 2585 - protein, 15 aa, Homo Sapiens
STVLLAMAFDRYVAI

SEQ ID NO: 2586 - protein, 15 aa, Homo Sapiens
CHPLRHATVLTLPRV

SEQ ID NO: 2587 - protein, 15 aa, Homo Sapiens
HATVLTLPRVTKIGV

SEQ ID NO: 2588 - protein, 15 aa, Homo Sapiens
VMKLACDDIRVNVVY

SEQ ID NO: 2589 - protein, 15 aa, Homo Sapiens
YGLIVIISAIGLDSL

SEQ ID NO: 2590 - protein, 15 aa, Homo Sapiens
DSPLPVILANIYLLV

SEQ ID NO: 2591 - protein, 15 aa, Homo Sapiens
TKEIRQRILRLFHVA

SEQ ID NO: 2592 - protein, 15 aa, Homo Sapiens
ATYFILIGLPGLEEA

SEQ ID NO: 2593 - protein, 15 aa, Homo Sapiens
EHSLHEPMYIFLCML

SEQ ID NO: 2594 - protein, 15 aa, Homo Sapiens
IHSLSGMESTVLLAM

SEQ ID NO: 2595 - protein, 15 aa, Homo Sapiens
IKQLPFCRSNILSHS

SEQ ID NO: 2596 - protein, 15 aa, Homo Sapiens
CDDIRVNVVYGLIVI

SEQ ID NO: 2597 - protein, 15 aa, Homo Sapiens
IVIISAIGLDSLLIS

SEQ ID NO: 2598 - protein, 15 aa, Homo Sapiens
SLLISFSYLLILKTV

SEQ ID NO: 2599 - protein, 15 aa, Homo Sapiens
LKTVLGLTREAQAKA

SEQ ID NO: 2600 - protein, 15 aa, Homo Sapiens
VLGLTREAQAKAFGT

SEQ ID NO: 2601 - protein, 15 aa, Homo Sapiens
AVFIFYVPFIGLSMV

SEQ ID NO: 2602 - protein, 15 aa, Homo Sapiens
VPFIGLSMVHRFSKR

SEQ ID NO: 2603 - protein, 15 aa, Homo Sapiens
LANIYLLVPPVLNPI

SEQ ID NO: 2604 - protein, 15 aa, Homo Sapiens
LYLIAVLGNLTIIYI

SEQ ID NO: 2605 - protein, 15 aa, Homo Sapiens
TIQFDACLLQIFAIH

SEQ ID NO: 2606 - protein, 15 aa, Homo Sapiens
ACLLQIFAIHSLSGM

SEQ ID NO: 2607 - protein, 15 aa, Homo Sapiens
YVAICHPLRHATVLT

SEQ ID NO: 2608 - protein, 15 aa, Homo Sapiens
MAPLPVFIKQLPFCR

SEQ ID NO: 2609 - protein, 15 aa, Homo Sapiens
MKLACDDIRVNVVYG

SEQ ID NO: 2610 - protein, 15 aa, Homo Sapiens
SFSYLLILKTVLGLT

SEQ ID NO: 2611 - protein, 15 aa, Homo Sapiens
KTVLGLTREAQAKAF

SEQ ID NO: 2612 - protein, 15 aa, Homo Sapiens
YLLVPPVLNPIVYGV

SEQ ID NO: 2613 - protein, 15 aa, Homo Sapiens
LNPIVYGVKTKEIRQ

SEQ ID NO: 2614 - protein, 15 aa, Homo Sapiens
GLPGLEEAQFWLAFP

SEQ ID NO: 2615 - protein, 15 aa, Homo Sapiens
NLTIIYIVRTEHSLH

SEQ ID NO: 2616 - protein, 15 aa, Homo Sapiens
KIGVAAVVRGAALMA

SEQ ID NO: 2617 - protein, 15 aa, Homo Sapiens
APLPVFIKQLPFCRS

SEQ ID NO: 2618 - protein, 15 aa, Homo Sapiens
FIGLSMVHRFSKRRD

SEQ ID NO: 2619 - protein, 15 aa, Homo Sapiens
LSMVHRFSKRRDSPL

SEQ ID NO: 2620 - protein, 15 aa, Homo Sapiens
VLTLPRVTKIGVAAV

SEQ ID NO: 2621 - protein, 15 aa, Homo Sapiens
VHRFSKRRDSPLPVI

SEQ ID NO: 2622 - protein, 15 aa, Homo Sapiens
GVKTKEIRQRILRLF

SEQ ID NO: 2623 - protein, 15 aa, Homo Sapiens
TIIYIVRTEHSLHEP

SEQ ID NO: 2624 - protein, 15 aa, Homo Sapiens
VRTEHSLHEPMYIFL

SEQ ID NO: 2625 - protein, 15 aa, Homo Sapiens
RSNILSHSYCLHQDV

SEQ ID NO: 2626 - protein, 15 aa, Homo Sapiens
LACDDIRVNVVYGLI

SEQ ID NO: 2627 - protein, 15 aa, Homo Sapiens
DSLLISFSYLLILKT

SEQ ID NO: 2628 - protein, 15 aa, Homo Sapiens
FSYLLILKTVLGLTR

SEQ ID NO: 2629 - protein, 15 aa, Homo Sapiens
SPLPVILANIYLLVP

SEQ ID NO: 2630 - protein, 15 aa, Homo Sapiens
NIYLLVPPVLNPIVY

SEQ ID NO: 2631 - protein, 15 aa, Homo Sapiens
TYFILIGLPGLEEAQ

SEQ ID NO: 2632 - protein, 15 aa, Homo Sapiens
SLYLIAVLGNLTIIY

SEQ ID NO: 2633 - protein, 15 aa, Homo Sapiens
FLCMLSGIDILISTS

SEQ ID NO: 2634 - protein, 15 aa, Homo Sapiens
LPRVTKIGVAAVVRG

SEQ ID NO: 2635 - protein, 15 aa, Homo Sapiens
LPVILANIYLLVPPV

SEQ ID NO: 2636 - protein, 15 aa, Homo Sapiens
RQRILRLFHVATHAS

SEQ ID NO: 2637 - protein, 15 aa, Homo Sapiens
YFILIGLPGLEEAQF

SEQ ID NO: 2638 - protein, 15 aa, Homo Sapiens
IIYIVRTEHSLHEPM

SEQ ID NO: 2639 - protein, 15 aa, Homo Sapiens
IDILISTSSMPKMLA

SEQ ID NO: 2640 - protein, 15 aa, Homo Sapiens
MPKMLAIFWFNSTTI

SEQ ID NO: 2641 - protein, 15 aa, Homo Sapiens
LSGMESTVLLAMAFD

SEQ ID NO: 2642 - protein, 15 aa, Homo Sapiens
ESTVLLAMAFDRYVA

SEQ ID NO: 2643 - protein, 15 aa, Homo Sapiens
ATVLTLPRVTKIGVA

SEQ ID NO: 2644 - protein, 15 aa, Homo Sapiens
RVNVVYGLIVIISAI

SEQ ID NO: 2645 - protein, 15 aa, Homo Sapiens
LIVIISAIGLDSLLI

SEQ ID NO: 2646 - protein, 15 aa, Homo Sapiens
YLLILKTVLGLTREA

SEQ ID NO: 2647 - protein, 15 aa, Homo Sapiens
LLILKTVLGLTREAQ

SEQ ID NO: 2648 - protein, 15 aa, Homo Sapiens
RFSKRRDSPLPVILA

SEQ ID NO: 2649 - protein, 15 aa, Homo Sapiens
IYLLVPPVLNPIVYG

SEQ ID NO: 2650 - protein, 15 aa, Homo Sapiens
QRILRLFHVATHASE

SEQ ID NO: 2651 - protein, 15 aa, Homo Sapiens
LYLIAVLGNLTIIYI

SEQ ID NO: 2652 - protein, 15 aa, Homo Sapiens
LTIIYIVRTEHSLHE

SEQ ID NO: 2653 - protein, 15 aa, Homo Sapiens
LSGIDILISTSSMPK

SEQ ID NO: 2654 - protein, 15 aa, Homo Sapiens
MLAIFWFNSTTIQFD

SEQ ID NO: 2655 - protein, 15 aa, Homo Sapiens
HATVLTLPRVTKIGV

SEQ ID NO: 2656 - protein, 15 aa, Homo Sapiens
KIGVAAVVRGAALMA

SEQ ID NO: 2657 - protein, 15 aa, Homo Sapiens
LKTVLGLTREAQAKA

SEQ ID NO: 2658 - protein, 15 aa, Homo Sapiens
VLGLTREAQAKAFGT

SEQ ID NO: 2659 - protein, 15 aa, Homo Sapiens
FIGLSMVHRFSKRRD

SEQ ID NO: 2660 - protein, 15 aa, Homo Sapiens
YLLVPPVLNPIVYGV

SEQ ID NO: 2661 - protein, 15 aa, Homo Sapiens
NPIVYGVKTKEIRQR

SEQ ID NO: 2662 - protein, 15 aa, Homo Sapiens
RQRILRLFHVATHAS

SEQ ID NO: 2663 - protein, 15 aa, Homo Sapiens
ATYFILIGLPGLEEA

SEQ ID NO: 2664 - protein, 15 aa, Homo Sapiens
EAQFWLAFPLCSLYL

SEQ ID NO: 2665 - protein, 15 aa, Homo Sapiens
AQFWLAFPLCSLYLI

SEQ ID NO: 2666 - protein, 15 aa, Homo Sapiens
CSLYLIAVLGNLTII

SEQ ID NO: 2667 - protein, 15 aa, Homo Sapiens
LAIFWFNSTTIQFDA

SEQ ID NO: 2668 - protein, 15 aa, Homo Sapiens
FDRYVAICHPLRHAT

SEQ ID NO: 2669 - protein, 15 aa, Homo Sapiens
NVVYGLIVIISAIGL

SEQ ID NO: 2670 - protein, 15 aa, Homo Sapiens
LISFSYLLILKTVLG

SEQ ID NO: 2671 - protein, 15 aa, Homo Sapiens
SFSYLLILKTVLGLT

SEQ ID NO: 2672 - protein, 15 aa, Homo Sapiens
FIFYVPFIGLSMVHR

SEQ ID NO: 2673 - protein, 15 aa, Homo Sapiens
ANIYLLVPPVLNPIV

SEQ ID NO: 2674 - protein, 15 aa, Homo Sapiens
LPGLEEAQFWLAFPL

SEQ ID NO: 2675 - protein, 15 aa, Homo Sapiens
AFPLCSLYLIAVLGN

SEQ ID NO: 2676 - protein, 15 aa, Homo Sapiens
LCSLYLIAVLGNLTI

SEQ ID NO: 2677 - protein, 15 aa, Homo Sapiens
SLYLIAVLGNLTIIY

SEQ ID NO: 2678 - protein, 15 aa, Homo Sapiens
IAVLGNLTIIYIVRT

SEQ ID NO: 2679 - protein, 15 aa, Homo Sapiens
LGNLTIIYIVRTEHS

SEQ ID NO: 2680 - protein, 15 aa, Homo Sapiens
NLTIIYIVRTEHSLH

SEQ ID NO: 2681 - protein, 15 aa, Homo Sapiens
IYIVRTEHSLHEPMY

SEQ ID NO: 2682 - protein, 15 aa, Homo Sapiens
HEPMYIFLCMLSGID

SEQ ID NO: 2683 - protein, 15 aa, Homo Sapiens
YIFLCMLSGIDILIS

SEQ ID NO: 2684 - protein, 15 aa, Homo Sapiens
LCMLSGIDILISTSS

SEQ ID NO: 2685 - protein, 15 aa, Homo Sapiens
IDILISTSSMPKMLA

SEQ ID NO: 2686 - protein, 15 aa, Homo Sapiens
MPKMLAIFWFNSTTI

SEQ ID NO: 2687 - protein, 15 aa, Homo Sapiens
PKMLAIFWFNSTTIQ

SEQ ID NO: 2688 - protein, 15 aa, Homo Sapiens
STTIQFDACLLQIFA

SEQ ID NO: 2689 - protein, 15 aa, Homo Sapiens
DACLLQIFAIHSLSG

SEQ ID NO: 2690 - protein, 15 aa, Homo Sapiens
ACLLQIFAIHSLSGM

SEQ ID NO: 2691 - protein, 15 aa, Homo Sapiens
LLQIFAIHSLSGMES

SEQ ID NO: 2692 - protein, 15 aa, Homo Sapiens
IFAIHSLSGMESTVL

SEQ ID NO: 2693 - protein, 15 aa, Homo Sapiens
IHSLSGMESTVLLAM

SEQ ID NO: 2694 - protein, 15 aa, Homo Sapiens
TVLLAMAFDRYVAIC

SEQ ID NO: 2695 - protein, 15 aa, Homo Sapiens
LLAMAFDRYVAICHP

SEQ ID NO: 2696 - protein, 15 aa, Homo Sapiens
YVAICHPLRHATVLT

SEQ ID NO: 2697 - protein, 15 aa, Homo Sapiens
CHPLRHATVLTLPRV

SEQ ID NO: 2698 - protein, 15 aa, Homo Sapiens
VLTLPRVTKIGVAAV

SEQ ID NO: 2699 - protein, 15 aa, Homo Sapiens
LPRVTKIGVAAVVRG

SEQ ID NO: 2700 - protein, 15 aa, Homo Sapiens
AALMAPLPVFIKQLP

SEQ ID NO: 2701 - protein, 15 aa, Homo Sapiens
PVFIKQLPFCRSNIL

SEQ ID NO: 2702 - protein, 15 aa, Homo Sapiens
IKQLPFCRSNILSHS

SEQ ID NO: 2703 - protein, 15 aa, Homo Sapiens
SYCLHQDVMKLACDD

SEQ ID NO: 2704 - protein, 15 aa, Homo Sapiens
HQDVMKLACDDIRVN

SEQ ID NO: 2705 - protein, 15 aa, Homo Sapiens
VMKLACDDIRVNVVY

SEQ ID NO: 2706 - protein, 15 aa, Homo Sapiens
DIRVNVVYGLIVIIS

SEQ ID NO: 2707 - protein, 15 aa, Homo Sapiens
VNVVYGLIVIISAIG

SEQ ID NO: 2708 - protein, 15 aa, Homo Sapiens
VYGLIVIISAIGLDS

SEQ ID NO: 2709 - protein, 15 aa, Homo Sapiens
YGLIVIISAIGLDSL

SEQ ID NO: 2710 - protein, 15 aa, Homo Sapiens
LIVIISAIGLDSLLI

SEQ ID NO: 2711 - protein, 15 aa, Homo Sapiens
IVIISAIGLDSLLIS

SEQ ID NO: 2712 - protein, 15 aa, Homo Sapiens
ISAIGLDSLLISFSY

SEQ ID NO: 2713 - protein, 15 aa, Homo Sapiens
AIGLDSLLISFSYLL

SEQ ID NO: 2714 - protein, 15 aa, Homo Sapiens
LDSLLISFSYLLILK

SEQ ID NO: 2715 - protein, 15 aa, Homo Sapiens
DSLLISFSYLLILKT

SEQ ID NO: 2716 - protein, 15 aa, Homo Sapiens
FSYLLILKTVLGLTR

SEQ ID NO: 2717 - protein, 15 aa, Homo Sapiens
GTCVSHVCAVFIFYV

SEQ ID NO: 2718 - protein, 15 aa, Homo Sapiens
VSHVCAVFIFYVPFI

SEQ ID NO: 2719 - protein, 15 aa, Homo Sapiens
VCAVFIFYVPFIGLS

SEQ ID NO: 2720 - protein, 15 aa, Homo Sapiens
AVFIFYVPFIGLSMV

SEQ ID NO: 2721 - protein, 15 aa, Homo Sapiens
IFYVPFIGLSMVHRF

SEQ ID NO: 2722 - protein, 15 aa, Homo Sapiens
PLPVILANIYLLVPP

SEQ ID NO: 2723 - protein, 15 aa, Homo Sapiens
LANIYLLVPPVLNPI

SEQ ID NO: 2724 - protein, 15 aa, Homo Sapiens
PPVLNPIVYGVKTKE

SEQ ID NO: 2725 - protein, 15 aa, Homo Sapiens
GLPGLEEAQFWLAFP

SEQ ID NO: 2726 - protein, 15 aa, Homo Sapiens
FWLAFPLCSLYLIAV

SEQ ID NO: 2727 - protein, 15 aa, Homo Sapiens
SGIDILISTSSMPKM

SEQ ID NO: 2728 - protein, 15 aa, Homo Sapiens
IQFDACLLQIFAIHS

SEQ ID NO: 2729 - protein, 15 aa, Homo Sapiens
CLLQIFAIHSLSGME

SEQ ID NO: 2730 - protein, 15 aa, Homo Sapiens
HSLSGMESTVLLAMA

SEQ ID NO: 2731 - protein, 15 aa, Homo Sapiens
VLLAMAFDRYVAICH

SEQ ID NO: 2732 - protein, 15 aa, Homo Sapiens
VAICHPLRHATVLTL

SEQ ID NO: 2733 - protein, 15 aa, Homo Sapiens
FIKQLPFCRSNILSH

SEQ ID NO: 2734 - protein, 15 aa, Homo Sapiens
LSHSYCLHQDVMKLA

SEQ ID NO: 2735 - protein, 15 aa, Homo Sapiens
MKLACDDIRVNVVYG

SEQ ID NO: 2736 - protein, 15 aa, Homo Sapiens
IISAIGLDSLLISFS

SEQ ID NO: 2737 - protein, 15 aa, Homo Sapiens
EAQAKAFGTCVSHVC

SEQ ID NO: 2738 - protein, 15 aa, Homo Sapiens
KAFGTCVSHVCAVFI

SEQ ID NO: 2739 - protein, 15 aa, Homo Sapiens
SPLPVILANIYLLVP

SEQ ID NO: 2740 - protein, 15 aa, Homo Sapiens
YGVKTKEIRQRILRL

SEQ ID NO: 2741 - protein, 15 aa, Homo Sapiens
GVKTKEIRQRILRLF

SEQ ID NO: 2742 - protein, 15 aa, Homo Sapiens
SATYFILIGLPGLEE

SEQ ID NO: 2743 - protein, 15 aa, Homo Sapiens
WLAFPLCSLYLIAVL

SEQ ID NO: 2744 - protein, 15 aa, Homo Sapiens
EPMYIFLCMLSGIDI

SEQ ID NO: 2745 - protein, 15 aa, Homo Sapiens
MYIFLCMLSGIDILI

SEQ ID NO: 2746 - protein, 15 aa, Homo Sapiens
AIFWFNSTTIQFDAC

SEQ ID NO: 2747 - protein, 15 aa, Homo Sapiens
LQIFAIHSLSGMEST

SEQ ID NO: 2748 - protein, 15 aa, Homo Sapiens
SHSYCLHQDVMKLAC

SEQ ID NO: 2749 - protein, 15 aa, Homo Sapiens
AKAFGTCVSHVCAVF

SEQ ID NO: 2750 - protein, 15 aa, Homo Sapiens
VFIFYVPFIGLSMVH

SEQ ID NO: 2751 - protein, 15 aa, Homo Sapiens
YVPFIGLSMVHRFSK

SEQ ID NO: 2752 - protein, 15 aa, Homo Sapiens
YFILIGLPGLEEAQF

SEQ ID NO: 2753 - protein, 15 aa, Homo Sapiens
FILIGLPGLEEAQFW

SEQ ID NO: 2754 - protein, 15 aa, Homo Sapiens
LIGLPGLEEAQFWLA

SEQ ID NO: 2755 - protein, 15 aa, Homo Sapiens
LIAVLGNLTIIYIVR

SEQ ID NO: 2756 - protein, 15 aa, Homo Sapiens
IIYIVRTEHSLHEPM

SEQ ID NO: 2757 - protein, 15 aa, Homo Sapiens
EHSLHEPMYIFLCML

SEQ ID NO: 2758 - protein, 15 aa, Homo Sapiens
PMYIFLCMLSGIDIL

SEQ ID NO: 2759 - protein, 15 aa, Homo Sapiens
FLCMLSGIDILISTS

SEQ ID NO: 2760 - protein, 15 aa, Homo Sapiens
GIDILISTSSMPKML

SEQ ID NO: 2761 - protein, 15 aa, Homo Sapiens
DILISTSSMPKMLAI

SEQ ID NO: 2762 - protein, 15 aa, Homo Sapiens
LSGMESTVLLAMAFD

SEQ ID NO: 2763 - protein, 15 aa, Homo Sapiens
ESTVLLAMAFDRYVA

SEQ ID NO: 2764 - protein, 15 aa, Homo Sapiens
ATVLTLPRVTKIGVA

SEQ ID NO: 2765 - protein, 15 aa, Homo Sapiens
VTKIGVAAVVRGAAL

SEQ ID NO: 2766 - protein, 15 aa, Homo Sapiens
VAAVVRGAALMAPLP

SEQ ID NO: 2767 - protein, 15 aa, Homo Sapiens
AAVVRGAALMAPLPV

SEQ ID NO: 2768 - protein, 15 aa, Homo Sapiens
GAALMAPLPVFIKQL

SEQ ID NO: 2769 - protein, 15 aa, Homo Sapiens
MAPLPVFIKQLPFCR

SEQ ID NO: 2770 - protein, 15 aa, Homo Sapiens
SNILSHSYCLHQDVM

SEQ ID NO: 2771 - protein, 15 aa, Homo Sapiens
QDVMKLACDDIRVNV

SEQ ID NO: 2772 - protein, 15 aa, Homo Sapiens
CDDIRVNVVYGLIVI

SEQ ID NO: 2773 - protein, 15 aa, Homo Sapiens
RVNVVYGLIVIISAI

SEQ ID NO: 2774 - protein, 15 aa, Homo Sapiens
SLLISFSYLLILKTV

SEQ ID NO: 2775 - protein, 15 aa, Homo Sapiens
YLLILKTVLGLTREA

SEQ ID NO: 2776 - protein, 15 aa, Homo Sapiens
LLILKTVLGLTREAQ

SEQ ID NO: 2777 - protein, 15 aa, Homo Sapiens
KTVLGLTREAQAKAF

SEQ ID NO: 2778 - protein, 15 aa, Homo Sapiens
LSMVHRFSKRRDSPL

SEQ ID NO: 2779 - protein, 15 aa, Homo Sapiens
DSPLPVILANIYLLV

SEQ ID NO: 2780 - protein, 15 aa, Homo Sapiens
LPVILANIYLLVPPV

SEQ ID NO: 2781 - protein, 15 aa, Homo Sapiens
PVILANIYLLVPPVL

SEQ ID NO: 2782 - protein, 15 aa, Homo Sapiens
IYLLVPPVLNPIVYG

SEQ ID NO: 2783 - protein, 15 aa, Homo Sapiens
VPPVLNPIVYGVKTK

SEQ ID NO: 2784 - protein, 15 aa, Homo Sapiens
QRILRLFHVATHASE

SEQ ID NO: 2785 - protein, 15 aa, Homo Sapiens
KIGVAAVVRGAALMA

SEQ ID NO: 2786 - protein, 15 aa, Homo Sapiens
FDRYVAICHPLRHAT

SEQ ID NO: 2787 - protein, 15 aa, Homo Sapiens
SFSYLLILKTVLGLT

SEQ ID NO: 2788 - protein, 15 aa, Homo Sapiens
NVVYGLIVIISAIGL

SEQ ID NO: 2789 - protein, 15 aa, Homo Sapiens
SATYFILIGLPGLEE

SEQ ID NO: 2790 - protein, 15 aa, Homo Sapiens
PFIGLSMVHRFSKRR

SEQ ID NO: 2791 - protein, 15 aa, Homo Sapiens
NLTIIYIVRTEHSLH

SEQ ID NO: 2792 - protein, 15 aa, Homo Sapiens
EPMYIFLCMLSGIDI

SEQ ID NO: 2793 - protein, 15 aa, Homo Sapiens
MAPLPVFIKQLPFCR

SEQ ID NO: 2794 - protein, 15 aa, Homo Sapiens
KAFGTCVSHVCAVFI

SEQ ID NO: 2795 - protein, 15 aa, Homo Sapiens
LISTSSMPKMLAIFW

SEQ ID NO: 2796 - protein, 15 aa, Homo Sapiens
HATVLTLPRVTKIGV

SEQ ID NO: 2797 - protein, 15 aa, Homo Sapiens
VLTLPRVTKIGVAAV

SEQ ID NO: 2798 - protein, 15 aa, Homo Sapiens
PVFIKQLPFCRSNIL

SEQ ID NO: 2799 - protein, 15 aa, Homo Sapiens
VYGLIVIISAIGLDS

SEQ ID NO: 2800 - protein, 15 aa, Homo Sapiens
LKTVLGLTREAQAKA

SEQ ID NO: 2801 - protein, 15 aa, Homo Sapiens
FIGLSMVHRFSKRRD

SEQ ID NO: 2802 - protein, 15 aa, Homo Sapiens
PIVYGVKTKEIRQRI

SEQ ID NO: 2803 - protein, 15 aa, Homo Sapiens
RQRILRLFHVATHAS

SEQ ID NO: 2804 - protein, 15 aa, Homo Sapiens
LCMLSGIDILISTSS

SEQ ID NO: 2805 - protein, 15 aa, Homo Sapiens
LLQIFAIHSLSGMES

SEQ ID NO: 2806 - protein, 15 aa, Homo Sapiens
VNVVYGLIVIISAIG

SEQ ID NO: 2807 - protein, 15 aa, Homo Sapiens
FSYLLILKTVLGLTR

SEQ ID NO: 2808 - protein, 15 aa, Homo Sapiens
CAVFIFYVPFIGLSM

SEQ ID NO: 2809 - protein, 15 aa, Homo Sapiens
PVILANIYLLVPPVL

SEQ ID NO: 2810 - protein, 15 aa, Homo Sapiens
LTIIYIVRTEHSLHE

SEQ ID NO: 2811 - protein, 15 aa, Homo Sapiens
LSGIDILISTSSMPK

SEQ ID NO: 2812 - protein, 15 aa, Homo Sapiens
MPKMLAIFWFNSTTI

SEQ ID NO: 2813 - protein, 15 aa, Homo Sapiens
DACLLQIFAIHSLSG

SEQ ID NO: 2814 - protein, 15 aa, Homo Sapiens
IFAIHSLSGMESTVL

SEQ ID NO: 2815 - protein, 15 aa, Homo Sapiens
AIGLDSLLISFSYLL

SEQ ID NO: 2816 - protein, 15 aa, Homo Sapiens
VFIFYVPFIGLSMVH

SEQ ID NO: 2817 - protein, 15 aa, Homo Sapiens
MYIFLCMLSGIDILI

SEQ ID NO: 2818 - protein, 15 aa, Homo Sapiens
LISFSYLLILKTVLG

SEQ ID NO: 2819 - protein, 15 aa, Homo Sapiens
LSMVHRFSKRRDSPL

SEQ ID NO: 2820 - protein, 15 aa, Homo Sapiens
ANIYLLVPPVLNPIV

SEQ ID NO: 2821 - protein, 15 aa, Homo Sapiens
LNPIVYGVKTKEIRQ

SEQ ID NO: 2822 - protein, 15 aa, Homo Sapiens
ATYFILIGLPGLEEA

SEQ ID NO: 2823 - protein, 15 aa, Homo Sapiens
EAQFWLAFPLCSLYL

SEQ ID NO: 2824 - protein, 15 aa, Homo Sapiens
LGNLTIIYIVRTEHS

SEQ ID NO: 2825 - protein, 15 aa, Homo Sapiens
YVPFIGLSMVHRFSK

SEQ ID NO: 2826 - protein, 15 aa, Homo Sapiens
IIYIVRTEHSLHEPM

SEQ ID NO: 2827 - protein, 15 aa, Homo Sapiens
CLLQIFAIHSLSGME

SEQ ID NO: 2828 - protein, 15 aa, Homo Sapiens
VLLAMAFDRYVAICH

SEQ ID NO: 2829 - protein, 15 aa, Homo Sapiens
VTKIGVAAVVRGAAL

SEQ ID NO: 2830 - protein, 15 aa, Homo Sapiens
SYCLHQDVMKLACDD

SEQ ID NO: 2831 - protein, 15 aa, Homo Sapiens
VLGLTREAQAKAFGT

SEQ ID NO: 2832 - protein, 15 aa, Homo Sapiens
SMVHRFSKRRDSPLP

SEQ ID NO: 2833 - protein, 15 aa, Homo Sapiens
MVHRFSKRRDSPLPV

SEQ ID NO: 2834 - protein, 15 aa, Homo Sapiens
LANIYLLVPPVLNPI

SEQ ID NO: 2835 - protein, 15 aa, Homo Sapiens
PPVLNPIVYGVKTKE

SEQ ID NO: 2836 - protein, 15 aa, Homo Sapiens
STVLLAMAFDRYVAI

SEQ ID NO: 2837 - protein, 15 aa, Homo Sapiens
YVAICHPLRHATVLT

SEQ ID NO: 2838 - protein, 15 aa, Homo Sapiens
VAICHPLRHATVLTL

SEQ ID NO: 2839 - protein, 15 aa, Homo Sapiens
LPRVTKIGVAAVVRG

SEQ ID NO: 2840 - protein, 15 aa, Homo Sapiens
FCRSNILSHSYCLHQ

SEQ ID NO: 2841 - protein, 15 aa, Homo Sapiens
YCLHQDVMKLACDDI

SEQ ID NO: 2842 - protein, 15 aa, Homo Sapiens
DIRVNVVYGLIVIIS

SEQ ID NO: 2843 - protein, 15 aa, Homo Sapiens
GLTREAQAKAFGTCV

SEQ ID NO: 2844 - protein, 15 aa, Homo Sapiens
DSPLPVILANIYLLV

SEQ ID NO: 2845 - protein, 15 aa, Homo Sapiens
KEIRQRILRLFHVAT

SEQ ID NO: 2846 - DNA, 5040 bp, Homo Sapiens
tgcgctccaccaagcctggctaacttttgcatttttaatagaggcagggtttcaccatgttggcctggctggtctcgaacccctgaccttgcgatctgcccacctcggcctcccaaagtgctgggattacaggcgtgagccactgtacctggcggggcttattgttttttaaaaagatttccaaaaccttgccctggcaattctgattttctgggcctggagcaggacctggagggatggtgttgtcaattactttagatgtttctatcaggaaagtttgagaaatggtattcaggcctaaacacaaacctctcttgaaatctcatcccagactgagcccctgctccctatcttaaattagattatagtaggtcttaaagtcagctgtagactgagcctctaaatctgaacccagacccaccctaaccccaggatacatcagaagagctggtcaatgtggaccattctgagcaatcctgcaagtctactctgatgggaaaaggctaagagcagtgccctgggcagcaacatcagctctgaagatgcaggactgtgttacatgttttatgagtgggtcttcacacactgagattcatgggacagtaatagaatctgcttgtgcagcactggggccttggagggtcagggtaaggctcaagatgtccaggaagttgtatataaggagaatcagagcagagagagactagggttcagaattaccaggatgacttagtcctgtttgttactgtcaccactccaatgccttttcctcattagtcctttctctcctctgagccacaactaaatgatgtttctacttttccctttctactttcctagaccctggattttgtatgcagaagccccagctcttggtccctatcatagccacttcaaatggaaatctggtccacgcagcatacttccttttggtgggtatccctggcctggggcctaccatacacttttggctggctttcccactgtgttttatgtatgccttggccaccctgggtaacctgaccattgtcctcatcattcgtgtggagaggcgactgcatgagcccatgtacctcttcctggccatgctttccactattgacctagtcctctcctctatcaccatgcccaagatggccagtcttttcctgatgggcatccaggagatcgagttcaacatttgcctggcccagatgttccttatccatgctctgtcagccgtggagtcagctgtcctgctggccatggcttttgaccgctttgtggccatttgccacccattgcgccatgcttctgtgctgacagggtgtactgtggccaagattggactatctgccctgaccagggggtttgtattcttcttcccactgcccttcatcctcaagtggttgtcctactgccaaacacatactgtcacacactccttctgtctgcaccaagatattatgaagctgtcctgtactgacaccagggtcaatgtggtttatggactcttcatcatcctctcagtcatgggtgtggactctctcttcattggcttctcatatatcctcatcctgtgggctgttttggagctgtcctctcggagggcagcactcaaggctttcaacacctgcatctcccacctctgtgctgttctggtcttctatgtacccctcattgggctctcggtggtgcataggctgggtggtcccacctccctcctccatgtggttatggctaatacctacttgctgctaccacctgtagtcaacccccttgtctatggagccaagaccaaagagatctgttcaagggtcctctgtatgttctcacaaggtggcaagtgagacaccttagtgtctcgcttctactactactacagaagatgggaatattaggatcctattgaatgccttggtgattaaagtatcaaacctattgtgctgtcttcttccagcaatttaagtagatcatgtattctgtctccaggaatgtgtcagtactgaacttatgaccctgtctggacatcctggagaatgactgcactagtccctctgctatggtggtcttgccttctccttctctctcagctagaaaatacatctagttttgacatggggaggctgtaaagatcacacctcatggttcattccagttttgaagtatgattttaatgttcttgcccccatgtgcccatgttggtgaatttgcatggactataaacgttattgcaaataccctaaagtggttacccagccataatcaggggttaatgaaggtatttggggaatagtaactggagagacagcaacaagacaagaggcagctcacatgcaatgttgaagtttctgtatgcaagagggtgtgttggcagatttgtgaaatctgcccatttgcatctgtatggctctatatgactatttgtccataagggtgccatgtattctggttgtgggtgtgaatgtgtgggtgtgtttatgtggacacttgcttttcagtgtgcgtatatgtgagagagagggtgcacacatggaatacgtactggttgtgtcctggtgagtgtggtagctatgtcctggcacatgtatgtttcatgagacgtgtctctgattgcgcatttgtatttctgtggtatctgttagttggtatatgatatgtgtctacgtgagaatgctggtgtctgtatctgcatggtgggcagtacctttatgtgtatctggtaagaatgctgcctctaccttttcttcctatttgtactatgtgaatgtggtgcatgaatgtgtggaatgtgtggaatgtgtagtattgggatgcctgtatctttcagcgtgtttgggtgtatgtccactgtgcataatatttgagatgtaaaaccattttgtgcggtatatgtgttattagttgtaagtcggtgaaatgtacatctgaattctgtgtgcatattgttggtactgatgctattttcgtgcatatgtctagtgtatatgttttaaggcaaactttctttgtgtgttgggtgtgtatgtgacacgaatggggacagcatctgtatttctgagcatggattgatgtgtggtgtctgtatgtatcttggaatggaggagggagattgaagaagtctggctgtgagcagcagaaataatttccaaagttgagtgacatgactctaagatgcccagtttctcggcctggggtcagcctgggtgatagctcagtctgtcagaatgaaaggaaacacggtgcttccttgctccaccttttcacaggccagaccacaccttcttcatcctgaacacaaggatttcaagggcttttgttacctcttcctacgtttcctgcctctgctatccgaggcactggcctccctaaaccctgccctcctgcctcaatagcaagtcatggtatcctcacctctcccttccctttttggcttatctgccaaacatgtataaaagtccttggttccccatctctactaaaaatacaacaattagccgggtgtgatggcgcgtgcctgtagtcccagctagttgggaggctgaggcaggagaaacgcttgagcccgcaaggtggaggttgcagtgagccgagatcatgccactgcactccagcctggtgacagagcaagactctgtgtcaaaaaaaaaaaaaaaaaaaaagccttggttgtagggagtttctcctaatccctctgggaaagcaagggtggaggggaagccagtcaatctcccttctgttgccgcatggaaactcccttaaggcaggaagctgaaaaaactgtagcattcacctcattattcaccttgtctcatgtctcactgtccttccacatgtctcattgttactccatattggatggaagtagaagtccctttggtattttttaaagtctttgccatgtctaagttaatgaggttaatggaggcagcagagatggctccagggttctgatagcaagtgtcaggctgcgtgctctgtaggcaccagaaactgttgtcaccagtaattttgatgtggtctgagttagaatggtctgatttgccatgatctatttaacatagcttgatttagcgtgtcctgtgttctgaatttaaaactcacagttgtgaaactgatcagtaaaaaataaggggagaccaactaaaaaccatgttgttctatttatagatgtagtttttacttatttcaaaatacgaggtatttagttttacattcaaattgttctctaactctctaaaatgttctctgactatttttgcccttaagggagaaaccagatgtcattggtcttacgtggctggtgttgggggtggggagggttaaagaaaccacgttctctgtcctcagccagaagttcagtaatccaaggccagagagtggacggcagaggcactgtccctggggaccttggttataagttatccagacacagggaccagagcctgggagacaaaaaaagatgtagccctagggctttgggaaaaggaggatggacccagtgaattccacgcttagcaaggacctaaacagtgtcccccaaatgagagaagggaggacagaaagaacacttcaggatggaaatgggctgacacttaaccgtggagtgtctctgcaaacttcctttgccattctcctgtttgagtttgataaacctgagaagagacttggataaagaccgtcacgaagactacactaatgagtttcttctagcttttttctactcactttccctatctatccttcacattgggagttggcatgaggatcccagcagcccatcaggggaggactctagagatccctttccccattgcctctcctccccatacccccaggcatatcctcccagggcacggaagctgagaagcagtccagaaccacagtgggctagtgaggggtacctgctgatgtaccctttggacagcattctgccccaccctgcaggaagaagcagaaggagggagagggtgaggcagagaataaataaccctgaccagggaggtccaagggagtaggcggagacagagaggctgtatttcagtgcagcctgccagacct

SEQ ID NO: 2847 - DNA, 50 bp, Homo Sapiens
ttttgcatttttaatagaggcagggtttcaccatgttggcctggctggtc

SEQ ID NO: 2848 - DNA, 50 bp, Homo Sapiens
caggaagttgtatataaggagaatcagagcagagagagactagggttcag

SEQ ID NO: 2849 - DNA, 50 bp, Homo Sapiens
tcagtgtgcgtatatgtgagagagagggtgcacacatggaatacgtactg

SEQ ID NO: 2850 - DNA, 50 bp, Homo Sapiens
tgacatgactctaagatgcccagtttctcggcctggggtcagcctgggtg

SEQ ID NO: 2851 - DNA, 50 bp, Homo Sapiens
gccaaacatgtataaaagtccttggttccccatctctactaaaaatacaa

SEQ ID NO: 2852 - DNA, 50 bp, Homo Sapiens
aactgatcagtaaaaaataaggggagaccaactaaaaaccatgttgttct

SEQ ID NO: 2853 - DNA, 50 bp, Homo Sapiens
aggcagagaataaataaccctgaccagggaggtccaagggagtaggcgga

SEQ ID NO: 2854 - DNA, 152 bp, Homo Sapiens
ccaggctggagtgcagtggcgcagtctcggctcactgcaacctctgcctcccaggttcaagtgattctcctgcctcagcctcctgagttgctgggattacaggcatgcagcaccatgcccagctaatttttgtatttttagtagagatgggg

SEQ ID NO: 2855 - DNA, 152 bp, Homo Sapiens
ccaggctggagtgcagtggcatgatctcggctcactgcaacctccaccttgcgggctcaagcgtttctcctgcctcagcctcccaactagctgggactacaggcacgcgccatcacacccggctaattgttgtatttttagtagagatgggg

SEQ ID NO: 2856 - DNA, 138 bp, Homo Sapiens
cctgtaatcccagctactgaggaggctgaggcaggagaatcacttgaacccagaaggcagaggttgcaatgagccgagattgcgccactgcactccagcctgggtgacagagtgagactctgtctcaaaaaaaaaaaa

SEQ ID NO: 2857 - DNA, 137 bp, Homo Sapiens
cctgtagtcccagctagttgggaggctgaggcaggagaaacgcttgagcccgcaaggtggaggttgcagtgagccgagatcatgccactgcactccagcctggtgacagagcaagactctgtgtcaaaaaaaaaaaa

SEQ ID NO: 2858 - DNA, 177 bp, Homo Sapiens
  misc_feature 150, 151, 152, 153, 154, 155, 156: n = A,T,C or G
tgagactgagtctcgctctgtgcccaggctggagtgcagtggtgcaaccttggctcactgcaagctccgcctcctgggttcacgccattctcctgcctcagcctcctgagtagctgggactacaggcacccgccaccacgcctggctaannnnnnngtatttttagtagagatgggg

SEQ ID NO: 2859 - DNA, 175 bp, Homo Sapiens
tgacacagagtcttgctctgtcaccaggctggagtgcagtggcatgatctcggctcactgcaacctccaccttgcgggctcaagcgtttctcctgcctcagcctcccaactagctgggactacaggcacgcgccatcacacccggctaattgttgtatttttagtagagatgggg

SEQ ID NO: 2860 - DNA, 123 bp, Homo Sapiens
atttttagtagagatggggtttcactgtgttagccaggatggtctcagtctcctgacctcgtgatctgcccaccttggcctcccaaagtgctgggattacaggcgtgagccactgcgcctggc

SEQ ID NO: 2861 - DNA, 123 bp, Homo Sapiens
atttttaatagaggcagggtttcaccatgttggcctggctggtctcgaacccctgaccttgcgatctgcccacctcggcctcccaaagtgctgggattacaggcgtgagccactgtacctggc

SEQ ID NO: 2862 - DNA, 115 bp, Homo Sapiens
gccaggcacagtggctcacgcctgtaatcccaacaccatgggaggctgagatgggtggatcacgaggtcaggagtttgagaccagcctgaccaacatggtgaaactctgtctcta

SEQ ID NO: 2863 - DNA, 115 bp, Homo Sapiens
cgcaaggtcaggggttcgagaccagccaggccaacatggtgaaaccctgcctctagccaggtacagtggctcacgcctgtaatcccagcactttgggaggccgaggtgggcagat

SEQ ID NO: 2864 - DNA, 427 bp, Homo Sapiens
gatcaaacttcttttccattcagagtcctctgattcagattttaatgttaacattttggaagacagtattcagaaaaaaaatttccttaataaaaatacaactcagatccttcaaatatgaaactggttggggaatctccattttttcaatattattttcttctttgttttcttgctacgtataattattaatatcctgactaggttgtggttggagggttattacttttcattttaccatgcagtccaaatctaaactgcttctactgatggtttacagcattctgagataagaatggtacatctagagaacatttgccaaaggcctaagcacagcaaaggaaaataaacacagaatataataaaatgagataatctagcttaaaactataacttcctctttagaactcccaaccacatttggatc

SEQ ID NO: 2865 - DNA, 3136 bp, Homo Sapiens
cagagaggctgtatttcagtgcagcctgccagacctcttctggaggaagactggacaaagggggtcacacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagtttgatgcttgtctgctacagatttttgccatccactccttatctggcatggaatccacagtgctgctggccatggcttttgaccgctatgtggccatctgtcacccactgcgccatgccacagtacttacgttgcctcgtgtcaccaaaattggtgtggctgctgtggtgcggggggctgcactgatggcaccccttcctgtcttcatcaagcagctgcccttctgccgctccaatatcctttcccattcctactgcctacaccaagatgtcatgaagctggcctgtgatgatatccgggtcaatgtcgtctatggccttatcgtcatcatctccgccattggcctggactcacttctcatctccttctcatatctgcttattcttaagactgtgttgggcttgacacgtgaagcccaggccaaggcatttggcacttgcgtctctcatgtgtgtgctgtgttcatattctatgtacctttcattggattgtccatggtgcatcgctttagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagccctaggtgtcagtgatcaaacttcttttccattcagagtcctctgattcagattttaatgttaacattttggaagacagtattcagaaaaaaaatttccttaataaaaaatacaactcagatccttcaaatatgaaactggttggggaatctccattttttcaatattattttcttctttgttttcttgctacatataattattaataccctgactaggttgtggttggagggttattacttttcattttaccatgcagtccaaatctaaactgcttctactgatggtttacagcattctgagataagaatggtacatctagagaacatttgccaaaggcctaagcacggcaaaggaaaataaacacagaatataataaaatgagataatctagcttaaaactataacttcctcttcagaactcccaaccacattggatctcagaaaaatgctgtcttcaaaatgacttctacagagaagaaataatttttcctctggacactagcacttaaggggaagattggaagtaaagccttgaaaagagtacatttacctacgttaatgaaagttgacacactgttctgagagttttcacagcatatggaccctgtttttcctatttaattttcttatcaaccctttaattaggcaaagatattattagtaccctcattgtagccatgggaaaattgatgttcagtggggatcagtgaattaaatggggtcatacaagtataaaaattaaaaaaaaaaaagacttcatgcccaatctcatatgatgtggaagaactgttagagagaccaacagggtagtgggttagagatttccagagtcttacattttctagaggaggtatttaatttcttctcactcatccagtgttgtatttaggaatttcctggcaacagaactcatggctttaatcccactagctattgcttattgtcctggtccaattgccaattacctgtgtcttggaagaagtgatttctaggttcaccattatggaagattcttattcagaaagtctgcatagggcttatagcaagttatttatttttaaaagttccataggtgattctgataggcagtgaggttagggagccaccagttatgatgggaagtatggaatggcaggtcttgaagataacattggccttttgagtgtgactcgtagctggaaagtgagggaatcttcaggaccatgctttatttggggctttgtgcagtatggaacagggactttgagaccaggaaagcaatctgacttaggcatgggaatcaggcatttttgcttctgaggggctattaccaagggttaataggtttcatcttcaacaggatatgacaacagtgttaaccaagaaactcaaattacaaatactaaaacatgtgatcatatatgtggtaagtttcattttctttttcaatcctcaggttccctgatatggattcctataacatgctttcatccccttttgtaatggatatcatatttggaaatgcctatttaatacttgtatttgctgctggactgtaagcccatgagggcactgtttattattgaatgtcatctctgttcatcattgactgctctttgctcatcattgaatcccccagcaaagtgcctagaacataatagtgcttatgcttgacaccggttatttttcatcaaacctgattccttctgtcctgaacacatagccaggcaattttccagccttctttgagttgggtattattaaattctggccattacttccaatgtgagtggaagtgacatgtgcaatttctatacctggctcataaaaccctcccatgtgcagcctttcatgttgacattaaatgtgacttgggaagctatgtgttacacagagtaaatcaccagaagcctggatttctgaaaaaactgtgcagagccaaacctctgtcatttgcaactcccacttgtatttgtacgaggcagttggataagtgaaaaataaagtactattgtgtcaagaaaaaaaaaaaaaaaaaaaaaaaaaaaaaaaaaaaaaaaaaaaaaaaaaaaa

SEQ ID NO: 2866 - protein, 318 aa, Homo Sapiens
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQIFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 2867 - protein, 301 aa, Homo Sapiens
GNYTVVTEFILLGLTDDITVSVILFVMFLIVYSVTLMGNLNIIVLIRTSPQLHTPMYLFLSHLAFLDIGYSSSVTPIMLRGFLRKGTFIPVAGCVAQLCIVVAFGTSESFLLASMAYDRYVAICSPLLYSTQMSSTVCILLVGTSYLGGWVNAWIFTGCSLNLSFCGPNKINHFFCDYSPLLKLSCSHDFSFEVIPAISSGSIIVVTVFIIALSYVYILVSILKMRSTEGRQKAFSTCTSHLTAVTLFFGTITFIYVMPQSSYSTDQNKVVSVFYTVVIPMLNPLIYSFRNKEVKEAMKKL

SEQ ID NO: 2868 - protein, 302 aa, Mus sp.
GNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQIFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRL

SEQ ID NO: 2869 - protein, 298 aa, Homo Sapiens
FILIGLPGLEEAQFWLAFPLCSLYLIAVLGNLTIIYIVRTEHSLHEPMYIFLCMLSGIDILISTSSMPKMLAIFWFNSTTIQFDACLLQIFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVA

SEQ ID NO: 2870 - protein, 299 aa, Rattus sp.
FMLIGIPGLEEAHFWFGFPLLSMYAVALFGNCIVVFIVRTERSLHAPMYLFLCMLAAIDLALSTSTMPKILALFWFDSREITFDACLAQMFFIHALSAIESTILLAMAFDRYVAICHPLRHAAVLNNTVTVQIGMVALVRGSLFFFPLPLLIKRLAFCHSNVLSHSYCVHQDVMKLAYTDTLPNVVYGLTAILLVMGVDVMFISLSYFLIIRAVLQLPSKSERAKAFGTCVSHIGVVLAFYVPLIGLSVVHRFGNSLDPIVHVLMGDVYLLLPPVINPIIYGAKTKQIRTRVLAMFKIS

SEQ ID NO: 2871 - protein, 298 aa, Homo Sapiens; identical to SEQ ID NO: 2869

SEQ ID NO: 2872 - protein, 299 aa, Homo Sapiens
FVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKIS

SEQ ID NO: 2873 - protein, 303 aa, Homo Sapiens
NESSATYFILIGLPGLEEAQFWLAFPLCSLYLIAVLGNLTIIYIVRTEHSLHEPMYIFLCMLSGIDILISTSSMPKMLAIFWFNSTTIQFDACLLQIFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFH

SEQ ID NO: 2874 - protein, 304 aa, Homo Sapiens
NVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFH

SEQ ID NO: 2875 - protein, 9 aa, Homo Sapiens
SYFPEITHI

SEQ ID NO: 2876 - protein, 14 aa, Clostridium tetani
QYIKANSKFIGITE

SEQ ID NO: 2877 - protein, 21 aa, Plasmodium falciparum
DIEKKIAKMEKASSVFNVVNS

SEQ ID NO: 2878 - protein, 16 aa, Streptococcus aureus
GAVDSILGGVATYGAA

SEQ ID NO: 2879 - protein, 13 aa, Artificial Sequence
  Artificially Synthesized Peptide
  VARIANT 3: Xaa = cyclohexylalanine, phenylalanine, or tyrosine
  VARIANT 1, 13: Xaa = D-alanine or L-alanine
XKXVAAWTLKAAX

SEQ ID NO: 2880 - protein, 14 aa, Artificial Sequence
  Artificially Synthesized Peptide
MVDPNGNESSATYF

SEQ ID NO: 2881 - protein, 4 aa, Artificial Sequence
  Artificially Synthesized Peptide
NESS

SEQ ID NO: 2882 - protein, 4 aa, Artificial Sequence
  Artificially Synthesized Peptide
NLTI

SEQ ID NO: 2883 - protein, 4 aa, Artificial Sequence
  Artificially Synthesized Peptide
NSTT

SEQ ID NO: 2884 - protein, 3 aa, Artificial Sequence
  Artificially Synthesized Peptide
SKR

SEQ ID NO: 2885 - protein, 4 aa, Artificial Sequence
  Artificially Synthesized Peptide
SLHE

SEQ ID NO: 2886 - protein, 4 aa, Artificial Sequence
  Artificially Synthesized Peptide
SGID

SEQ ID NO: 2887 - protein, 4 aa, Artificial Sequence
  Artificially Synthesized Peptide
SGME

SEQ ID NO: 2888 - protein, 6 aa, Artificial Sequence
  Artificially Synthesized Peptide
GNESSA

SEQ ID NO: 2889 - protein, 6 aa, Artificial Sequence
  Artificially Synthesized Peptide
GLEEAQ

SEQ ID NO: 2890 - protein, 6 aa, Artificial Sequence
  Artificially Synthesized Peptide
GMESTV

SEQ ID NO: 2891 - protein, 6 aa, Artificial Sequence
  Artificially Synthesized Peptide
GTCVSH

SEQ ID NO: 2892 - protein, 17 aa, Artificial Sequence
  Artificially Synthesized Peptide
MESTVLLAMAFDRYVAI

SEQ ID NO: 2893 - protein, 6 aa, Homo Sapiens
TILVMS

SEQ ID NO: 2894 - protein, 7 aa, Homo Sapiens
LIVMATQ

SEQ ID NO: 2895 - protein, 6 aa, Homo Sapiens
IVMATL

SEQ ID NO: 2896 - protein, 7 aa, Homo Sapiens
VSMATLI

SEQ ID NO: 2897 - protein, 8 aa, Homo Sapiens
YFWIVLMT

SEQ ID NO: 2898 - protein, 6 aa, Homo Sapiens
FIYWLM

SEQ ID NO: 2899 - protein, 8 aa, Homo Sapiens
VILFMWYA

SEQ ID NO: 2900 - protein, 8 aa, Homo Sapiens
FYLWMIVA

SEQ ID NO: 2901 - protein, 8 aa, Homo Sapiens
FWYLIMVA

SEQ ID NO: 2902 - protein, 8 aa, Homo Sapiens
FWYLIVMA

SEQ ID NO: 2903 - protein, 6 aa, Homo Sapiens
QLIVMP

SEQ ID NO: 2904 - protein, 8 aa, Homo Sapiens
FWYMIVLA

SEQ ID NO: 2905 - protein, 4 aa, Homo Sapiens
DEAS

SEQ ID NO: 2906 - protein, 7 aa, Homo Sapiens
LMVQIAT

SEQ ID NO: 2907 - protein, 6 aa, Homo Sapiens
VLIMAT

SEQ ID NO: 2908 - protein, 11 aa, Homo Sapiens
LMVISATFCGD

SEQ ID NO: 2909 - protein, 6 aa, Homo Sapiens
KYRHFA

SEQ ID NO: 2910 - protein, 12 aa, Homo Sapiens
VTMLISAGNCDF

SEQ ID NO: 2911 - protein, 4 aa, Homo Sapiens
KRYH

SEQ ID NO: 2912 - protein, 4 aa, Homo Sapiens
YFWM

SEQ ID NO: 2913 - protein, 4 aa, Homo Sapiens
FLIW

SEQ ID NO: 2914 - protein, 7 aa, Homo Sapiens
MVTALIS

SEQ ID NO: 2915 - protein, 8 aa, Homo Sapiens
MVALFIST

SEQ ID NO: 2916 - protein, 7 aa, Homo Sapiens
AVTMSLI

SEQ ID NO: 2917 - protein, 8 aa, Homo Sapiens
LMFWYAIV

SEQ ID NO: 2918 - protein, 8 aa, Homo Sapiens
LMFWYIVA

SEQ ID NO: 2919 - protein, 8 aa, Homo Sapiens
LIVFWYAM

SEQ ID NO: 2920 - protein, 8 aa, Homo Sapiens
IMFWYALV

SEQ ID NO: 2921 - protein, 9 aa, Homo Sapiens
ATIVLMFWY

SEQ ID NO: 2922 - protein, 7 aa, Homo Sapiens
FMYLIVW

SEQ ID NO: 2923 - protein, 9 aa, Homo Sapiens
VSTCPALIM

SEQ ID NO: 2924 - protein, 7 aa, Homo Sapiens
MFLIVWY

SEQ ID NO: 2925 - protein, 4 aa, Homo Sapiens
PAMQ

SEQ ID NO: 2926 - protein, 9 aa, Homo Sapiens
VMATSPLIC

SEQ ID NO: 2927 - protein, 9 aa, Homo Sapiens
IVMSACTPL

SEQ ID NO: 2928 - protein, 6 aa, Homo Sapiens
LIVMFY

SEQ ID NO: 2929 - protein, 7 aa, Homo Sapiens
LIVMFAY

SEQ ID NO: 2930 - protein, 6 aa, Homo Sapiens
DNQEST

SEQ ID NO: 2931 - protein, 9 aa, Homo Sapiens
VMSTACPLI

SEQ ID NO: 2932 - protein, 6 aa, Homo Sapiens
LIVMAT

SEQ ID NO: 2933 - protein, 6 aa, Homo Sapiens
FIYWLM

SEQ ID NO: 2934 - protein, 4 aa, Homo Sapiens
LIVM

SEQ ID NO: 2935 - protein, 4 aa, Homo Sapiens
GFYW

SEQ ID NO: 2936 - protein, 4 aa, Homo Sapiens
DEQN

SEQ ID NO: 2937 - protein, 4 aa, Homo Sapiens
GRHK

SEQ ID NO: 2938 - protein, 8 aa, Homo Sapiens
ASTCLIVM

SEQ ID NO: 2939 - protein, 4 aa, Homo Sapiens
GSTC

SEQ ID NO: 2940 - protein, 4 aa, Homo Sapiens
ASTC

SEQ ID NO: 2941 - protein, 5 aa, Homo Sapiens
DEAQN

SEQ ID NO: 2942 - protein, 5 aa, Homo Sapiens
YFWQN

SEQ ID NO: 2943 - protein, 5 aa, Homo Sapiens
PASTC

SEQ ID NO: 2944 - protein, 8 aa, Homo Sapiens
RHKGLIVM

SEQ ID NO: 2945 - protein, 6 aa, Homo Sapiens
RHKYFW

SEQ ID NO: 2946 - protein, 7 aa, Homo Sapiens
STCLIVM

SEQ ID NO: 2947 - protein, 9 aa, Homo Sapiens
RHKDEPYFW

SEQ ID NO: 2948 - protein, 4 aa, Homo Sapiens
PRHK

SEQ ID NO: 2949 - protein, 7 aa, Homo Sapiens
LMIVQAT

SEQ ID NO: 2950 - protein, 5 aa, Homo Sapiens
DERKH

SEQ ID NO: 2951 - protein, 7 aa, Homo Sapiens
FYWLVIM

SEQ ID NO: 2952 - protein, 4 aa, Homo Sapiens
RKHA

SEQ ID NO: 2953 - protein, 11 aa, Homo Sapiens
LMVISATFCGD

SEQ ID NO: 2954 - protein, 7 aa, Homo Sapiens
PRHKYFW

SEQ ID NO: 2955 - protein, 12 aa, Homo Sapiens
VTLMISAGNCDF

SEQ ID NO: 2956 - protein, 6 aa, Homo Sapiens
YFWRHK

SEQ ID NO: 2957 - protein, 5 aa, Homo Sapiens
DERHK

SEQ ID NO: 2958 - protein, 4 aa, Homo Sapiens
YFWP

SEQ ID NO: 2959 - protein, 4 aa, Homo Sapiens
AYFW

SEQ ID NO: 2960 - protein, 6 aa, Homo Sapiens
YFWSTC

SEQ ID NO: 2961 - protein, 7 aa, Homo Sapiens
YFWLIVM

SEQ ID NO: 2962 - protein, 6 aa, Homo Sapiens
RHKFWY

SEQ ID NO: 2963 - protein, 5 aa, Homo Sapiens
DEQNP

SEQ ID NO: 2964 - protein, 7 aa, Homo Sapiens
FWYLIVM

SEQ ID NO: 2965 - protein, 7 aa, Homo Sapiens
LIVMFWY

SEQ ID NO: 2966 - protein, 11 aa, Homo Sapiens
AGPDERHKSTC

SEQ ID NO: 2967 - protein, 5 aa, Homo Sapiens
AGPQN

SEQ ID NO: 2968 - protein, 5 aa, Homo Sapiens
RHKQN

SEQ ID NO: 2969 - protein, 5 aa, Homo Sapiens
ALIVM

SEQ ID NO: 2970 - protein, 5 aa, Homo Sapiens
FWYAP

SEQ ID NO: 2971 - protein, 6 aa, Homo Sapiens
GPQNDE

SEQ ID NO: 2972 - protein, 6 aa, Homo Sapiens
GDESTC

SEQ ID NO: 2973 - protein, 5 aa, Homo Sapiens
RHKDE

SEQ ID NO: 2974 - protein, 5 aa, Homo Sapiens
QNDGE

SEQ ID NO: 2975 - protein, 8 aa, Homo Sapiens
RHKLIVMP

SEQ ID NO: 2976 - protein, 4 aa, Homo Sapiens
LVIM

The invention claimed is:

1. A method to identify an agent that decreases 101P3A11 protein activity, comprising:
   providing a first sample of cells and a second sample of cells, wherein the cells of each sample express 101P3A11;
   contacting the first sample with a candidate compound and
   measuring 101P3A11 protein activity in the first sample with the candidate compound;
   measuring 101P3A11 protein activity in the second sample, wherein the second sample has not been contacted with said candidate compound;
   comparing the measured 101P3A11 protein activity in said first and second samples;
   whereby a diminution in the 101P3A11 protein activity in said first sample as compared to said second sample identifies said compound as an agent that decreases 101P3A11 protein activity;
   wherein 101P3A11 protein is SEQ ID NO: 2866; and
   wherein said activity comprises 101P3A11-mediated cAMP accumulation or a downstream signaling effect thereof which is selected from the group consisting of:
   101P3A11-mediated ERK phosphorylation;
   101P3A11-mediated p38 phosphorylation;
   101P3A11-mediated cell growth;

101P3A11-mediated O-alpha subunit activation; and
101P3A11-mediated cell adhesion.

2. The method of claim 1, wherein said cells have been modified to contain an expression system for said 101P3A11 protein.

3. The method of claim 1, wherein the candidate compound is an antibody that binds specifically to the 101P3A11 protein.

* * * * *